(12) United States Patent
Binkowski et al.

(10) Patent No.: US 9,840,730 B2
(45) Date of Patent: *Dec. 12, 2017

(54) OPLOPHORUS-DERIVED LUCIFERASES, NOVEL COELENTERAZINE SUBSTRATES, AND METHODS OF USE

(71) Applicant: Promega Corporation, Madison, WI (US)

(72) Inventors: Brock Binkowski, Sauk City, WI (US); Lance P. Encell, Fitchburg, WI (US); Mary Hall, Waunakee, WI (US); Matthew B. Robers, Madison, WI (US); Michael R. Slater, Madison, WI (US); Keith V. Wood, Mount Horeb, WI (US); Monika G. Wood, Mount Horeb, WI (US)

(73) Assignee: PROMEGA CORPORATION, Madison, WI (US)

(*) Notice: Subject to any disclaimer, the term of this patent is extended or adjusted under 35 U.S.C. 154(b) by 0 days.

This patent is subject to a terminal disclaimer.

(21) Appl. No.: 14/160,278

(22) Filed: Jan. 21, 2014

(65) Prior Publication Data

US 2014/0227759 A1    Aug. 14, 2014

Related U.S. Application Data

(63) Continuation of application No. 13/287,986, filed on Nov. 2, 2011, now Pat. No. 8,669,103.

(60) Provisional application No. 61/409,422, filed on Nov. 2, 2010.

(51) Int. Cl.
  *C12Q 1/66* (2006.01)
  *C07D 487/04* (2006.01)
  *C12N 9/02* (2006.01)
  *C12N 15/52* (2006.01)

(52) U.S. Cl.
  CPC ............ *C12Q 1/66* (2013.01); *C07D 487/04* (2013.01); *C12N 9/0004* (2013.01); *C12N 9/0069* (2013.01); *C12N 15/52* (2013.01); *C12Y 113/12005* (2013.01); *C12Y 113/12007* (2013.01); *A01K 2217/072* (2013.01)

(58) Field of Classification Search
  None
  See application file for complete search history.

(56) References Cited

U.S. PATENT DOCUMENTS

| | | |
|---|---|---|
| 5,670,356 A | 9/1997 | Sherf et al. |
| 5,837,465 A | 11/1998 | Squirrel |
| 5,998,204 A | 12/1999 | Tsien et al. |
| 6,132,983 A | 10/2000 | Lowe |
| 6,171,808 B1 | 1/2001 | Squirrell |
| 6,265,177 B1 | 7/2001 | Squirrell |
| 6,387,675 B1 | 5/2002 | Wood et al. |
| 6,544,754 B2 | 4/2003 | Inouye |
| 6,552,179 B1 | 4/2003 | Wood et al. |
| 6,602,677 B1 | 8/2003 | Wood et al. |
| 7,078,181 B2 | 7/2006 | Hawkins et al. |
| 7,108,996 B2 | 9/2006 | Hawkins et al. |
| 7,118,878 B1 | 10/2006 | Hawkins |
| 7,125,697 B2 | 10/2006 | Inouye |
| 7,238,842 B2 | 7/2007 | Wood et al. |
| 7,241,584 B2 | 7/2007 | Wood et al. |
| 7,268,229 B2 | 9/2007 | Wood et al. |
| 7,416,854 B2 | 8/2008 | Riss et al. |
| 7,425,436 B2 | 9/2008 | Darzins et al. |
| 7,429,472 B2 | 9/2008 | Darzins et al. |
| 7,537,912 B2 | 5/2009 | Wood et al. |
| 7,553,632 B2 | 6/2009 | Niles et al. |
| 7,692,002 B2 | 4/2010 | Alberto et al. |
| 7,692,022 B2 | 4/2010 | Cali et al. |
| 7,728,118 B2 | 6/2010 | Wood et al. |
| 7,741,067 B2 | 6/2010 | Hawkins et al. |
| 7,867,726 B2 | 1/2011 | Wood et al. |
| 7,879,540 B1 | 2/2011 | Wood et al. |
| 7,888,086 B2 | 2/2011 | Darzins et al. |
| 7,906,282 B2 | 3/2011 | Wood |
| 7,906,298 B1 | 3/2011 | Squirrell et al. |
| 7,935,803 B2 | 5/2011 | Darzins et al. |
| 7,951,550 B2 | 5/2011 | Cali |
| 8,003,350 B2 | 8/2011 | Fujii et al. |

(Continued)

FOREIGN PATENT DOCUMENTS

| EP | 1281762 A2 | 2/2003 |
|---|---|---|
| EP | 1148139 | 8/2004 |

(Continued)

OTHER PUBLICATIONS

International Search Report and Written Opinion for Application No. PCT/US2011/058924 dated Jan. 24, 2012 (8 pages).
Skolnick & Fetrow, "From genes to protein structure and function: novel applications of computational approaches in the genomic era." Tibtech Jan. 2000, 18:34-39.
Inouye et al., "Secretional luciferase of the luminous shrimp *Oplophorus gracilirostris*: cDNA cloning of a novel imidazopyazinon luciferase." FEBS Letters Sep. 2000, 481(1):19-25.
Loening et al., "Concensus guided mutagenesis of Renilla Luciferase yields enhanced stability and light output." Protein Engineering, Des and Sel. Sep. 2006, 391-400.

(Continued)

*Primary Examiner* — Paul J Holland
(74) *Attorney, Agent, or Firm* — Casimir Jones SC; David W. Staple

(57) ABSTRACT

An isolated polynucleotide encoding a modified luciferase polypeptide and substrates. The OgLuc variant polypeptide has at least 60% amino acid sequence identity to SEQ ID NO: 1 and at least one amino acid substitution at a position corresponding to an amino acid in SEQ ID NO: 1. The OgLuc variant polypeptide has at least one of enhanced luminescence, enhanced signal stability, and enhanced protein stability relative to the corresponding polypeptide of the wild-type *Oplophorus* luciferase.

16 Claims, 118 Drawing Sheets

(56) References Cited

U.S. PATENT DOCUMENTS

| | | | |
|---|---|---|---|
| 8,008,006 B2 | 8/2011 | Wood et al. | |
| 8,030,017 B2 | 10/2011 | Wood et al. | |
| 8,106,052 B2 | 1/2012 | Cali et al. | |
| 8,168,405 B2 | 5/2012 | Darzins et al. | |
| 8,183,007 B2 | 5/2012 | Zegzouti | |
| 8,183,036 B2 | 5/2012 | Fan | |
| 8,202,700 B2 | 6/2012 | Darzins et al. | |
| 8,669,103 B2 * | 3/2014 | Binkowski et al. | 435/325 |
| 2003/0068801 A1 | 4/2003 | Wood et al. | |
| 2003/0153090 A1 | 8/2003 | Wood et al. | |
| 2003/0166905 A1 | 9/2003 | Wood et al. | |
| 2003/0232404 A1 | 12/2003 | Wood et al. | |
| 2004/0002127 A1 | 1/2004 | Inoue et al. | |
| 2004/0096924 A1 | 5/2004 | Hawkins et al. | |
| 2004/0171099 A1 | 9/2004 | Cali et al. | |
| 2004/0178545 A1 | 9/2004 | Cates et al. | |
| 2004/0214258 A1 | 10/2004 | Wood et al. | |
| 2004/0224377 A1 | 11/2004 | Hawkins et al. | |
| 2005/0026171 A1 | 2/2005 | Hawkins et al. | |
| 2005/0153310 A1 | 7/2005 | Fan et al. | |
| 2005/0164321 A1 | 7/2005 | Riss et al. | |
| 2005/0272114 A1 | 12/2005 | Darzins et al. | |
| 2006/0024808 A1 | 2/2006 | Darzins et al. | |
| 2006/0051827 A1 | 3/2006 | Hawkins et al. | |
| 2006/0068395 A1 | 3/2006 | Wood et al. | |
| 2006/0127988 A1 | 6/2006 | Wood | |
| 2006/0183212 A1 | 8/2006 | Wood et al. | |
| 2007/0015790 A1 | 1/2007 | Cali | |
| 2007/0087400 A1 | 4/2007 | Darzins et al. | |
| 2008/0026407 A1 | 1/2008 | Wood et al. | |
| 2008/0050760 A1 | 2/2008 | Wood et al. | |
| 2008/0070299 A1 | 3/2008 | Wood et al. | |
| 2008/0090291 A1 | 4/2008 | Wood et al. | |
| 2008/0145882 A1 | 6/2008 | Darzins et al. | |
| 2008/0248511 A1 | 10/2008 | Daily | |
| 2008/0268482 A1 | 10/2008 | Riss et al. | |
| 2008/0274488 A1 | 11/2008 | Darzins et al. | |
| 2008/0299593 A1 | 12/2008 | Cali | |
| 2009/0017482 A1 | 1/2009 | Riss et al. | |
| 2009/0023173 A1 | 1/2009 | Cali et al. | |
| 2009/0098627 A1 | 4/2009 | Darzins et al. | |
| 2009/0137019 A1 | 5/2009 | Wood et al. | |
| 2009/0253131 A1 | 10/2009 | Wigdal et al. | |
| 2009/0275051 A1 | 11/2009 | Niles et al. | |
| 2009/0305280 A1 | 12/2009 | Binkowski et al. | |
| 2009/0311769 A1 | 12/2009 | Wood et al. | |
| 2010/0075350 A1 | 3/2010 | Zegzouti et al. | |
| 2010/0273186 A1 | 10/2010 | Wood et al. | |
| 2010/0281552 A1 | 11/2010 | Encell | |
| 2011/0003316 A1 | 1/2011 | Cali et al. | |
| 2011/0039257 A1 | 2/2011 | Binkowski et al. | |
| 2011/0081670 A1 | 4/2011 | Hawkins et al. | |
| 2011/0171673 A1 | 7/2011 | Darzins et al. | |
| 2011/0177540 A1 | 7/2011 | Squirrell | |
| 2011/0201024 A1 | 8/2011 | Wood et al. | |
| 2011/0207195 A1 | 8/2011 | Darzins et al. | |
| 2011/0283373 A1 | 11/2011 | Binkowski et al. | |
| 2012/0009647 A1 | 1/2012 | Wood et al. | |
| 2012/0058505 A1 | 3/2012 | Helms et al. | |

FOREIGN PATENT DOCUMENTS

| | | |
|---|---|---|
| EP | 1479763 A2 | 11/2004 |
| EP | 1630231 A2 | 3/2006 |
| EP | 1894933 A2 | 3/2008 |
| EP | 1935980 A1 | 6/2008 |
| EP | 1935986 A2 | 6/2008 |
| EP | 1978091 A1 | 10/2008 |
| EP | 1978092 A1 | 10/2008 |
| EP | 2071023 A2 | 6/2009 |
| EP | 2272972 A1 | 1/2011 |
| EP | 2272973 A1 | 1/2011 |
| EP | 2277872 A1 | 1/2011 |
| EP | 2284271 A1 | 2/2011 |
| EP | 2298902 A1 | 3/2011 |
| EP | 2308978 A1 | 4/2011 |
| EP | 2325328 A1 | 5/2011 |
| EP | 2325329 A1 | 5/2011 |
| EP | 2327768 A2 | 6/2011 |
| EP | 2341134 A2 | 7/2011 |
| EP | 2366777 A1 | 9/2011 |
| EP | 2366778 A1 | 9/2011 |
| EP | 2366779 A1 | 9/2011 |
| EP | 2366780 A1 | 9/2011 |
| EP | 2368976 A1 | 9/2011 |
| EP | 2368977 A1 | 9/2011 |
| EP | 2369006 A1 | 9/2011 |
| EP | 2374875 A2 | 10/2011 |
| EP | 2395078 A2 | 12/2011 |
| EP | 2395358 A2 | 12/2011 |
| EP | 2420573 | 2/2012 |
| JP | 2000197484 | 7/2000 |
| JP | 2002320482 | 11/2002 |
| JP | 2005245457 | 9/2005 |
| JP | 2007097577 | 4/2007 |
| JP | 2007-306871 | 11/2007 |
| WO | 95/18853 | 7/1995 |
| WO | 95/25798 | 9/1995 |
| WO | 96/07100 | 3/1996 |
| WO | 96/22376 | 7/1996 |
| WO | 98/46729 | 10/1998 |
| WO | 98/46739 | 10/1998 |
| WO | 99/14336 | 3/1999 |
| WO | 00/24878 | 5/2000 |
| WO | 01/20002 | 3/2001 |
| WO | 01/31028 | 5/2001 |
| WO | 01/96862 | 12/2001 |
| WO | 02/16944 | 2/2002 |
| WO | 03/040100 | 5/2003 |
| WO | 2004/027378 | 4/2004 |
| WO | 2004/059294 | 7/2004 |
| WO | 2004/072232 | 8/2004 |
| WO | 2004/072299 | 8/2004 |
| WO | 2005/038029 | 4/2005 |
| WO | 2005/073722 | 8/2005 |
| WO | 2006/034061 | 3/2006 |
| WO | 2006/093529 | 9/2006 |
| WO | 2006/130551 | 12/2006 |
| WO | 2007/120522 | 10/2007 |
| WO | 2008/054821 | 5/2008 |
| WO | 2008/086035 | 7/2008 |
| WO | 2008/118445 | 10/2008 |
| WO | 2009/061413 | 5/2009 |
| WO | 2009/142735 | 11/2009 |
| WO | 2010/011607 | 1/2010 |
| WO | 2010/127368 | 11/2010 |
| WO | 2011/038219 | 3/2011 |
| WO | 2011/143339 | 11/2011 |
| WO | 2012/030960 | 3/2012 |

OTHER PUBLICATIONS

Fujii et al. "Increase in Bioluminescence intensity of firefly luciferase using genetic modification." Analy. Biochem. Jun. 2007, 366 (2):131-136.

Angelucci, F. et al., "Schistosoma mansoni fatty acid binding protein: specificity and functional control as revealed by crystallographic structure," Biochem. (2004) 43:13000-13011.

Arnold, K. et al., "The SWISS-MODEL workspace: a web-based environment for protein structure homology modelling," Bioinformatics (2006) 22(2):195-201.

Becker, M.M. et al., "Gene cloning, overproduction and purification of a functionally active cytoplasmic fatty acid-binding protein (Sj-FABPc) from the human blood fluke Schistosoma japonicum," Gene (1994) 148:321-325.

Cowan, S.W. et al., "Crystallographic studies on a family of cellular lipophillic transport proteins," J. Mol. Biol. (1993) 230;1225-1246.

Daughtery, P.S. et al., "Quantitative analysis of the effect of the mutation frequency on the affinity maturation of single chain Fv antibodies," Proc. Natl. Acad. Sci. USA (2000) 97(5):2029-2034.

Dennell, R. et al., "Observations on the luminescence of bathypelagic crustacea decapoda of the Bermuda area," J. linnean. Soc. London (1955) XLII:393-406.

(56) References Cited

OTHER PUBLICATIONS

Flower, D.R. et al., "A structural signature characteristic of the calycin protein superfamily," Protein Pept. Lett. (1995) 2(2):341-350.
Flower, D.R. et al., "Structure and sequence relationships in the lipocalins and related proteins," Protein Sci. (1993) 2:753-761.
International Search Report and Written Opinion for Application No. PCT/US2011/059017 dated Jan. 18, 2012 (8 pages).
Flower, D.R. et al., "The lipocalin protein family—structure and function," Biochem. J. (1996) 318:1-14.
Flower, D.R. et al., "The lipocalin protein family—structural and sequence overview," Biochimica et Biophysica Acta (2000) 1482:9-24.
Head, J.F. et al., "The crystal structure of the photoprotein aequorin at 2.3A resolution," Nature (2000) 405:372-376.
Herring, P.J. et al., "Bioluminescence in crustacea," J. Crust. Biol. (1985) 5(4):557-573.
Herring, P.J. et al., "The spectral characteristics of luminous marine organisms," Proc. Royal Society London Series B. Biological Sciences (1983) 220(1219):183-217.
Herring, P.J., "Bioluminescence in decapod crustacea," J. Mar. Biol. Assoc. UK (1976) 156:1029-1047.
Inoue, S. et al., "Complete structure of renilla luciferin and luciferyl sulfate," Tetra. Lett (1977) 31:2685-2688.
Inouye, S. et al., "Overexpression, purification and characterization of the catalytic component of oplophorus luciferase in the deep sea shrimp," Protein Exp. Purification (2007) 56(2):261-268.
Johnson, F.H. et al., "Introduction to the cypridina system," Meth. Enzym. (1978) 57:331-364.
Kabsch, W. et al., "Dictionary of protein secondary structure: pattern recognition of hydrogen-bonded and geometrical features," Biopolymers (1983) 22:2577-2637.
Karplus, K. et al., "Hidden Markov models for detecting remote protein homologies," Bioinformatics (1998) 14 (10):846-856.
King, R.D. et al., "Identification and application of the concepts important for accurate and reliable protein secondary structure prediction," Protein Sci. (1996) 5:2298-2310.
Kunkel, T.A., "Rapid and efficient site-specific mutagenesis without phenotypic selection," Proc. Natl. Acad. Sci. USA (1985) 82(2):488-492.
Kurowski, M.A. et al., "GeneSilico protein structure prediction meta-server," Nucl. Acids. Res. (2003) 31 (13):3305-3307.
Lorenz, W.W. et al., "Isolation and expression of a cDNA encoding renilla reinformis luciferase," Proc. Natl. Acad. Sci. USA (1991) 88:4438-4442.
McGuffin, L.J. et al., "The PSIPRED protein structure prediction server," Bioinformatics (2000) 16(4):404-405.
Murray, E.E. et al., "Codon usage in plant genes," Nucl. Acids. Res. (1989) 17(2):477-498.
Nakamura, H. et al., "Efficient bioluminescence of bisdeoxycoelenterazine with the luciferase of a deep-sea shrimp oplophorus," Tetra. Lett. (1997) 38(36):6405-6406.
Needleman, S.B. et al., "A general method applicable to the search for similarities in the amino acid sequence of two proteins," J. Mol. Biol. (1970) 48:443-453.
Nowel, M.S. et al., "Cuticular photophores of two decapod crustaceans, *Oplophorus spinosus* and *Systellaspis debilis*," Biol. Bull. (1998) 195:290-307.
Parsons, M.R. et al., "Crystal structure of a quinoenzyme: copper amine oxidase of *Escherichia coli* at 2 A resolution," Structure (1995) 3:1171-1184.
Pearson, W.R. et al., "Improved tools for biological sequence comparison," Proc. Natl. Acad. Sci. USA (1988) 85:2444-2448.
Pollastri, G. et al., "Porter: a new, accurate server for protein secondary structure prediction," Bioinformatics (2005) 21(8):1719-1720.
Poupin, J., "Plancton marin bioluminescent," Rapport Scientifique du Leon (Sep. 1999) 1-83.
Schagat, T. et al., "KRX autoinduction protocol: a convenient method for protein expression," Promega Notes (2008) 98:16-18.
Schultz, L.W. et al., "Crystal structure of a pH-regulated luciferase catalyzing the bioluminescent oxidation of an open tetrapyrrole," Proc. Natl. Acad. Sci. USA (2005) 102(5):1378-1383.
Shimomura, O. et al., "Properties and reaction mechanism of the bioluminescence system of the deep-sea shrimp *Oplophorus gracilorostris*," Biochem. (1978) 17:994-998.
Skerra, A., "Lipocalins as a scaffold," Biochem et Biophys. Acta (2000) 1482:337-350.
Smith, T.F. et al., "Identification of common molecular subsequences," J. Mol. Biol. (1981) 147:195-197.
Thompson, E.M. et al., "Cloning and expression of cDNA for the luciferase from the marine ostracod *Vargula hilgendorfii*," Proc. Natl. Acad. Sci. USA (1989) 86:6567-6571.
Wada, K. et al., "Codon usage tabulated from the GenBank genetic sequence data," Nucl. Acids Res. (1990) 18 (Supp):2367-2411.
International Search Report and Written Opinion for Application No. PCT/US2010/033449 dated Aug. 18, 2010 (12 pages).
Wells, J.A. "Additivity of Mutational Effects in Proteins." Perspectives in Biotechnology, American Chemical Society Sep. 18, 1990, 29(37): 5809-5817.
Chakravarty et al., "Accuracy of structure-derived properties in simple comparative models of protein structures." Nucleic Acids Research 2009, 33(1): 244-259.
Todd et al., "Evolution of Function in Protein Superfamilies, from a Structural Perspective." J. Mol. Biol 2001, 307:1113-1143.
Pichler et al., "Imaging reversal of multidrug resistance in living mice with bioluminescence: MDR1 P-glycoprotein transports coelenterazine." Proc. Natl. Acaa. Sci. USA 2004, 101(6): 1702-1707.
Shimomura et al., "Sem-synthetic aequorins with improved sensitivity to CA2+ ions." Biochem. J. 1989, 261:913-920.
English Abstract for JP2000197484, retrieved Oct. 20, 2015, 1 page.
English Abstract for JP2002320482, retrieved Oct. 20, 2015, 1 page.
English Abstract for JP2005245457, retrieved Oct. 20, 2015, 1 page.
English Abstract for JP2007097577, retrieved Oct. 20, 2015, 1 page.

* cited by examiner

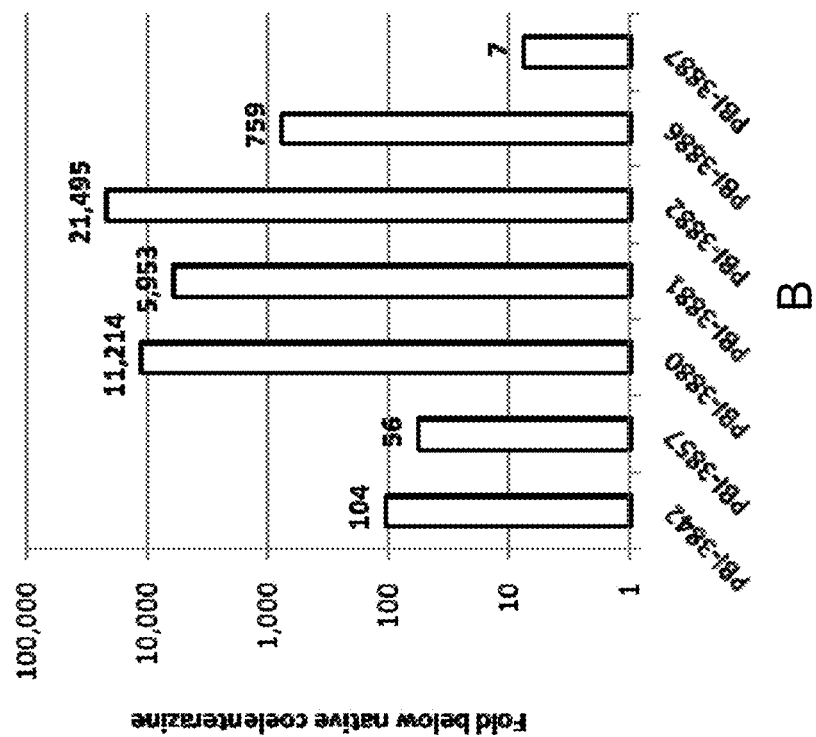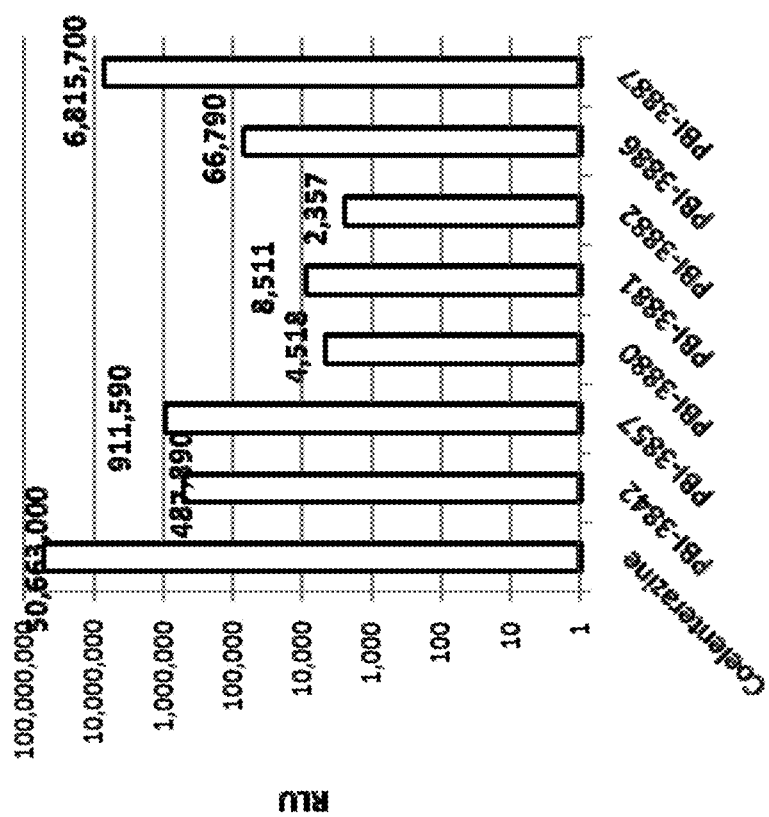
FIG. 5

| POSITION | Clone(AA sequence) | Colenta | h | h,h | 2-me | PBI-3840 | PBI-3897 | PBI-3889 | PBI-3899 | PBI-3900 |
|---|---|---|---|---|---|---|---|---|---|---|
| 15 | 03F2 (G15R) | 0.004 | 0.059 | 0.024 | 0.004 | 0.008 | 0.003 | 0.031 | 0.003 | 0.011 |
| 18 | 40H11 (Q18L) | 0.38 | 0.26 | 0.51 | 0.20 | 0.28 | 4.46 | 0.53 | 0.17 | 0.43 |
| 20 | 16C5 (Q20R) | 5.66 | 1.96 | 1.88 | 9.02 | 4.72 | 6.50 | 1.61 | 4.92 | 2.41 |
| 22 | 14C1 (L22I) | 0.17 | 0.63 | 0.47 | 0.41 | 0.14 | 0.08 | 0.43 | 0.49 | 0.66 |
| 27 | 11E8 (L27V) | 0.34 | 1.74 | 1.88 | 0.55 | 0.35 | 0.03 | 2.03 | 0.88 | 2.22 |
| 54 | 18F8 (F54S) | 0.21 | 0.40 | 1.78 | 0.13 | 0.53 | 0.55 | 1.62 | 0.18 | 0.69 |
| 54 | 29H7 (F54I) | 11.30 | 1.71 | 1.48 | 24.59 | 18.11 | 18.09 | 2.32 | 10.57 | 2.99 |
| 58 | 30E4 (V58I) | 0.27 | 0.89 | 1.00 | 0.96 | 0.43 | 0.21 | 1.15 | 0.65 | 1.02 |
| 72 | 04G7 (L72Q) | 4.46 | 1.25 | 1.15 | 9.36 | 5.65 | 8.84 | 1.13 | 4.04 | 1.53 |
| 75 | 28B2 (M75K) | 4.16 | 1.57 | 2.30 | 5.43 | 4.92 | 5.67 | 2.38 | 4.03 | 2.11 |
| 77 | 18C4 (F77T) | 1.62 | 0.55 | 1.22 | 7.82 | 2.06 | 2.28 | 1.33 | 2.67 | 0.86 |
| 77 | 42E4 (F77C) | 0.13 | 0.46 | 0.99 | 3.43 | 0.20 | 0.02 | 1.27 | 0.56 | 0.58 |
| 77 | 50D12 (F77T) | 1.48 | 0.52 | 1.15 | 7.75 | 1.87 | 2.20 | 1.24 | 2.46 | 0.78 |
| 89 | 35D11 (K89E) | 3.02 | 0.59 | 1.26 | 5.27 | 3.39 | 5.19 | 1.41 | 2.32 | 0.95 |
| 90 | 10F2 (I90T) | 2.20 | 0.48 | 0.66 | 0.00 | 3.90 | 5.41 | 0.84 | 1.36 | 0.55 |
| 92 | 04A12 (L92H) | 0.89 | 0.39 | 0.61 | 7.31 | 3.72 | 14.25 | 0.53 | 0.89 | 0.45 |
| 109 | 43F9 (Y109F) | 0.48 | 0.33 | 0.97 | 0.36 | 1.49 | 24.83 | 0.94 | 0.43 | 0.56 |
| 127 | 30D6 (V127A) | 0.23 | 0.50 | 0.54 | 0.26 | 0.81 | 1.00 | 0.57 | 0.26 | 0.42 |
| 139 | 27B8 (D139G) | 0.01 | 0.03 | 0.14 | 0.00 | 0.03 | 0.00 | 0.16 | 0.00 | 0.02 |
| 164 | 25A1 (C164S) | 2.47 | 1.79 | 1.53 | 2.74 | 3.37 | 5.10 | 1.63 | 2.87 | 2.05 |
| 14-89 | 25F2 (A14V,K89E) | 3.05 | 0.81 | 1.22 | 5.43 | 3.82 | 6.21 | 1.58 | 2.32 | 0.91 |
| 27-33 | 47D8 (L27M,K33N) | 0.59 | 1.71 | 2.05 | 0.85 | 0.95 | 0.27 | 2.12 | 1.23 | 1.85 |
| 49-72 | 26F1 (E49K,L72Q) | 6.19 | 1.48 | 1.35 | 10.72 | 6.90 | 9.99 | 1.32 | 4.76 | 1.70 |
| 54-66 | 48G3 (F54I,S66T) | 7.33 | 1.06 | 0.91 | 16.39 | 11.27 | 8.28 | 1.42 | 6.63 | 1.85 |
| 54-67 | 35B8 (F54S,G67S) | 0.33 | 0.75 | 2.49 | 0.19 | 0.78 | 0.87 | 2.25 | 0.27 | 1.05 |
| 55-117 | 05H8 (D55G,I117F) | 0.24 | 0.53 | 0.62 | 0.00 | 0.25 | 0.22 | 0.65 | 0.21 | 0.45 |
| 56-93 | 46A11 (I56V,H93R) | 0.35 | 0.61 | 1.53 | 0.22 | 0.42 | 0.18 | 1.50 | 0.36 | 0.88 |
| 68-75 | 04E2 (F68S,M75K) | 3.43 | 1.20 | 1.53 | 4.37 | 3.91 | 4.12 | 1.62 | 3.24 | 1.57 |
| 77-126 | 27B9 (F77T,T126R) | 0.87 | 0.15 | 0.69 | 4.87 | 0.80 | 1.00 | 0.79 | 1.14 | 0.32 |
| 77-39 | 33E2 (F77T,I39I) | 0.95 | 0.34 | 0.69 | 6.30 | 1.32 | 1.64 | 0.74 | 1.47 | 0.47 |
| 89-148 | 50E7 (K89E,S148T) | 1.81 | 0.48 | 0.85 | 3.74 | 2.23 | 3.20 | 0.94 | 1.59 | 0.65 |
| 90-77 | 02D10 (I90V,F77T) | 2.05 | 0.70 | 1.17 | 17.39 | 6.32 | 10.88 | 1.05 | 2.37 | 0.73 |
| 106-164 | 17E6 (M106K,C164S) | 4.14 | 2.46 | 2.52 | 3.77 | 5.06 | 7.72 | 2.71 | 3.80 | 2.82 |
| 23-58-169 | 47G12 (E23K,V58L,A169V) | 0.06 | 0.44 | 0.49 | 1.49 | 0.10 | 0.01 | 0.68 | 0.58 | 0.92 |
| 33-76-89 | 17C5 (K33N,I76N,K89E) | 1.27 | 0.68 | 2.02 | 1.33 | 2.22 | 1.12 | 2.24 | 1.07 | 0.79 |
| 68-90-145 | 04D10 (F68S,I90V,P145L) | 4.17 | 1.40 | 1.65 | 0.00 | 6.09 | 5.96 | 1.72 | 3.82 | 1.49 |
| 59-109-113-136 | 41H10 (I59T,Y109F,P113T,L136M) | 0.06 | 0.06 | 0.26 | 0.04 | 0.46 | 8.09 | 0.25 | 0.06 | 0.10 |

FIG. 6A

| POSITION | Clone(AA sequence) | Colenterazine | H | h,h | v | PBI-3912 | PBI-3913 | PBI-3925 | PBI-3897 | PBI-3899 |
|---|---|---|---|---|---|---|---|---|---|---|
| 15 | 03F2 (G15R) | 0.003 | 0.040 | 0.018 | 0.022 | 0.005 | 0.019 | 0.005 | 0.002 | 0.003 |
| 18 | 40H11 (Q18L) | 0.20 | 0.18 | 0.30 | 0.11 | 0.13 | 0.14 | 0.06 | 3.24 | 0.09 |
| 20 | 16C5 (Q20R) | 4.08 | 1.30 | 1.14 | 5.25 | 5.27 | 5.34 | 4.83 | 3.33 | 3.32 |
| 22 | 14C1 (L22I) | 0.13 | 0.56 | 0.40 | 0.13 | 0.10 | 0.11 | 0.21 | 0.06 | 0.39 |
| 27 | 11E8 (L27V) | 0.16 | 1.01 | 0.95 | 0.22 | 0.07 | 0.08 | 0.26 | 0.02 | 0.45 |
| 54 | 18F8 (F54S) | 0.16 | 0.37 | 1.44 | 0.55 | 0.17 | 0.22 | 0.26 | 0.38 | 0.14 |
| 54 | 29H7 (F54I) | 10.34 | 1.45 | 1.06 | 8.28 | 18.52 | 15.79 | 18.92 | 11.15 | 9.62 |
| 58 | 30E4 (V58I) | 0.17 | 0.63 | 0.69 | 0.20 | 0.19 | 0.21 | 0.83 | 0.13 | 0.43 |
| 72 | 04G7 (L72Q) | 2.96 | 1.02 | 0.69 | 1.03 | 5.81 | 5.81 | 5.65 | 7.42 | 3.09 |
| 75 | 28B2 (M75K) | 2.93 | 1.35 | 1.53 | 1.06 | 3.98 | 3.89 | 3.86 | 4.73 | 2.93 |
| 77 | 18C4 (F77T) | 1.01 | 0.53 | 0.85 | 1.31 | 0.78 | 0.74 | 7.08 | 1.69 | 2.30 |
| 77 | 42E4 (F77C) | 0.10 | 0.34 | 0.70 | 0.61 | 0.03 | 0.04 | 0.88 | 0.01 | 0.41 |
| 77 | 50D12 (F77T) | 0.88 | 0.46 | 0.72 | 1.21 | 0.62 | 0.60 | 5.94 | 1.41 | 1.92 |
| 89 | 35D11 (K89E) | 2.17 | 0.53 | 0.89 | 0.76 | 3.64 | 3.98 | 3.51 | 3.89 | 1.77 |
| 90 | 10F2 (I90T) | 1.86 | 0.39 | 0.49 | 1.71 | 10.44 | 11.10 | 3.76 | 3.61 | 1.20 |
| 92 | 04A12 (L92H) | 0.65 | 0.08 | 0.27 | 27.76 | 4.48 | 2.79 | 5.01 | 6.72 | 0.60 |
| 109 | 43F9 (Y109F) | 0.36 | 0.20 | 0.76 | 0.84 | 0.73 | 0.60 | 1.04 | 18.04 | 0.31 |
| 127 | 30D6 (V127A) | 0.16 | 0.31 | 0.30 | 0.16 | 0.32 | 0.45 | 0.50 | 0.43 | 0.15 |
| 139 | 27B8 (D139G) | 0.00 | 0.02 | 0.08 | 0.10 | 0.02 | 0.04 | 0.01 | 0.00 | 0.00 |
| 164 | 25A1 (C164S) | 3.10 | 1.71 | 1.47 | 3.91 | 3.04 | 3.29 | 3.43 | 4.33 | 3.14 |
| 14-89 | 25F2 (A14V,K89E) | 3.31 | 0.75 | 1.16 | 1.34 | 5.26 | 5.90 | 5.28 | 4.68 | 2.46 |
| 27-33 | 47D8 (L27M,K33N) | 0.52 | 1.41 | 1.46 | 1.55 | 0.41 | 0.41 | 1.21 | 0.17 | 1.05 |
| 49-72 | 26F1 (E49K,L72Q) | 3.61 | 1.09 | 0.76 | 2.24 | 6.83 | 6.59 | 6.42 | 6.33 | 3.40 |
| 54-66 | 48G3 (F54I,S66T) | 10.15 | 1.40 | 1.01 | 7.67 | 17.73 | 14.90 | 18.29 | 10.14 | 9.44 |
| 54-67 | 35B8 (F54S,G67S) | 0.23 | 0.46 | 1.73 | 1.28 | 0.23 | 0.29 | 0.32 | 0.42 | 0.18 |
| 55-117 | 05H8 (D55G,I117F) | 0.18 | 0.38 | 0.46 | 0.44 | 0.12 | 0.14 | 0.10 | 0.14 | 0.16 |
| 56-93 | 46A11 (I56V,H93R) | 0.24 | 0.39 | 0.96 | 0.88 | 0.10 | 0.11 | 0.21 | 0.11 | 0.24 |
| 68-75 | 04E2 (F68S,M75K) | 2.39 | 1.01 | 1.04 | 0.74 | 3.01 | 3.04 | 3.61 | 3.58 | 2.47 |
| 77-126 | 27B9 (F77T,T126R) | 0.34 | 0.15 | 0.37 | 0.51 | 0.28 | 0.24 | 2.16 | 0.58 | 0.74 |
| 77-39 | 33E2 (F77T,T39I) | 0.50 | 0.24 | 0.35 | 0.67 | 0.42 | 0.38 | 3.27 | 0.96 | 0.96 |
| 89-148 | 50E7 (K89E,S148T) | 2.97 | 0.66 | 1.15 | 1.50 | 4.57 | 5.01 | 4.36 | 3.91 | 2.28 |
| 90-77 | 02D10 (I90V,F77T) | 1.44 | 0.63 | 0.80 | 3.79 | 2.80 | 2.47 | 24.43 | 7.82 | 2.14 |
| 106-164 | 17E6 (M106K,C164S) | 2.71 | 1.50 | 1.52 | 4.80 | 2.79 | 2.92 | 2.93 | 3.47 | 2.48 |
| 23-58-169 | 47G12 (E23K,V58L,A169V) | 0.05 | 0.41 | 0.39 | 0.31 | 0.03 | 0.03 | 1.24 | 0.01 | 0.48 |
| 33-76-89 | 17C5 (K33N,I76N,K89E) | 1.53 | 0.63 | 1.74 | 2.16 | 0.86 | 0.94 | 1.38 | 0.91 | 1.03 |
| 68-90-145 | 04D10 (F68S,I90V,P145L) | 2.63 | 0.88 | 0.95 | 2.74 | 4.40 | 4.42 | 5.96 | 4.82 | 2.48 |
| 59-109-113-136 | 41H10 (I59T,Y109F,P113T,L136M) | 0.08 | 0.07 | 0.29 | 0.20 | 0.23 | 0.22 | 0.41 | 7.52 | 0.07 |

| POSITION | Clone (AA sequence) | coel | h | h,h | 2-me | PBI-3889 | PBI-3939 | PBI-3899 | PBI-3933 | PBI-3932 | PBI-3946 | PBI-3897 | PBI-3841 | PB-3896 | PBI-3925 |
|---|---|---|---|---|---|---|---|---|---|---|---|---|---|---|---|
| 15 | 03F2 (G15R) | 0.003 | 0.041 | 0.021 | 0.005 | 0.025 | 0.019 | 0.003 | 0.003 | 0.009 | 0.003 | 0.002 | 0.003 | 0.013 | 0.004 |
| 18 | 40H11 (Q18L) | 0.31 | 0.34 | 0.48 | 0.19 | 0.43 | 0.39 | 0.09 | 0.09 | 0.08 | 0.09 | 3.86 | 4.08 | 61.25 | 0.09 |
| 20 | 16C5 (Q20R) | 2.84 | 1.04 | 0.92 | 3.91 | 0.86 | 1.15 | 2.79 | 2.79 | 4.70 | 2.18 | 2.70 | 3.59 | 3.78 | 3.81 |
| 22 | 14C1 (L22I) | 0.12 | 0.52 | 0.39 | 0.30 | 0.33 | 0.29 | 0.20 | 0.20 | 0.15 | 0.20 | 0.06 | 0.09 | 0.12 | 0.20 |
| 27 | 11E 8 (L27V) | 0.25 | 1.64 | 1.48 | 0.40 | 1.53 | 1.44 | 0.47 | 0.47 | 0.52 | 0.61 | 0.03 | 0.04 | 0.09 | 0.40 |
| 54 | 18F8 (F54S) | 0.2 | 0.6 | 1.6 | 0.1 | 1.4 | 1.3 | 0.4 | 0.4 | 0.3 | 0.5 | 0.4 | 0.4 | 0.5 | 0.3 |
| 54 | 29H7 (F54I) | 6.77 | 1.18 | 0.78 | out of range | 1.57 | 0.50 | 5.38 | 5.38 | 17.81 | 3.69 | 8.04 | 6.14 | 9.69 | 12.97 |
| 58 | 30E 4 (V58I) | 0.17 | 0.66 | 0.72 | 0.62 | 0.80 | 0.91 | 0.63 | 0.63 | 0.90 | 0.48 | 0.12 | 0.14 | 0.27 | 0.83 |
| 72 | 04G7 (L72Q) | 4.07 | 1.27 | 0.93 | 7.23 | 1.08 | 1.27 | 5.03 | 5.03 | 7.66 | 3.14 | 6.40 | 7.30 | 6.20 | 6.85 |
| 75 | 2B82 (M75K) | 3.25 | 1.44 | 1.68 | 3.97 | 1.86 | 2.01 | 3.77 | 3.77 | 4.33 | 3.33 | 3.89 | 3.85 | 3.41 | 4.15 |
| 77 | 18C4 (F77T) | 0.86 | 0.48 | 0.74 | 4.98 | 0.96 | 0.81 | 3.37 | 3.37 | 4.84 | 1.81 | 1.32 | 0.56 | 0.91 | 5.04 |
| 77 | 42E 4 (F77C) | 0.07 | 0.30 | 0.65 | 1.89 | 0.77 | 0.46 | 0.50 | 0.50 | 2.18 | 0.34 | 0.02 | 0.02 | 0.08 | 0.63 |
| 77 | 50D12 (F77T) | 0.87 | 0.50 | 0.76 | 4.89 | 0.99 | 0.85 | 3.45 | 3.45 | 4.92 | 1.86 | 1.30 | 0.55 | 0.88 | 5.14 |
| 89 | 35D11 (K89E) | 2.17 | 0.60 | 0.88 | 3.39 | 0.97 | 1.02 | 2.28 | 2.28 | 3.65 | 2.09 | 3.17 | 2.95 | 2.56 | 3.01 |
| 90 | 10F2 (I90T) | 1.68 | 0.37 | 0.51 | 2.60 | 0.72 | 0.62 | 2.08 | 2.08 | 4.64 | 1.35 | 2.99 | 1.93 | 4.51 | 3.57 |
| 92 | 04A12 (L92H) | 0.59 | 0.03 | 0.24 | 5.44 | 0.23 | 0.11 | 1.86 | 1.86 | 3.25 | 0.88 | 8.81 | 23.30 | 22.13 | 3.53 |
| 109 | 43F9 (Y109F) | 0.25 | 0.20 | 0.65 | 0.11 | 0.73 | 0.64 | 0.64 | 0.64 | 0.71 | 0.44 | 13.07 | 4.80 | 1.20 | 0.85 |
| 127 | 30D6 (V127A) | 0.22 | 0.40 | 0.46 | 0.15 | 0.48 | 0.52 | 0.65 | 0.65 | 0.75 | 0.62 | 0.50 | 0.55 | 0.53 | 0.66 |
| 139 | 27B8 (D139G) | 0.00 | 0.02 | 0.11 | 0.01 | 0.10 | 0.09 | 0.02 | 0.02 | 0.01 | 0.02 | 0.01 | 0.01 | 0.04 | 0.01 |
| 164 | 25A1 (C164S) | 2.10 | 1.30 | 1.12 | 1.71 | 1.28 | 1.30 | 2.30 | 2.30 | 2.26 | 2.11 | 3.14 | 5.76 | 1.96 | 2.66 |
| 14-89 | 25F2 (A14V,K89E) | 1.93 | 0.53 | 0.73 | 2.80 | 0.98 | 1.00 | 2.15 | 2.15 | 3.78 | 1.88 | 3.07 | 2.32 | 2.94 | 3.01 |
| 27-33 | 47D8 (L27M,K33N) | 0.38 | 1.26 | 1.37 | 0.46 | 1.73 | 1.79 | 1.27 | 1.27 | 0.92 | 1.46 | 0.16 | 0.21 | 0.25 | 1.02 |
| 49-72 | 26F1 (F49K,L72Q) | 4.26 | 1.22 | 0.91 | 7.26 | 1.10 | 1.26 | 5.21 | 5.21 | 7.70 | 3.23 | 6.66 | 7.28 | 6.41 | 6.91 |
| 54-66 | 48G3 (F54I, S66T) | 10.93 | 1.88 | 1.21 | out of range | 2.46 | 0.76 | 8.62 | 8.62 | 28.26 | 5.88 | 9.90 | 7.53 | 11.93 | 20.94 |
| 54-67 | 35B8 (F54S,G67S) | 0.19 | 0.59 | 1.64 | 0.10 | 1.44 | 1.30 | 0.47 | 0.47 | 0.30 | 0.58 | 0.43 | 0.51 | 0.47 | 0.32 |
| 55-117 | 05H8 (D55G,I117F) | 0.17 | 0.37 | 0.49 | 0.08 | 0.51 | 0.54 | 0.15 | 0.15 | 0.09 | 0.19 | 0.12 | 0.10 | 0.13 | 0.10 |
| 56-93 | 46A11 (I56V,H93R) | 0.21 | 0.45 | 0.99 | 0.12 | 0.97 | 0.80 | 0.26 | 0.26 | 0.13 | 0.14 | 0.09 | 0.06 | 0.15 | 0.18 |
| 68-75 | 04E 2 (F68S,M75K) | 2.80 | 1.14 | 1.27 | 4.47 | 1.50 | 1.62 | 3.71 | 3.71 | 4.35 | 3.04 | 3.91 | 3.46 | 2.89 | 4.20 |
| 77-126 | 27B9 (F77T,T126R) | 0.55 | 0.26 | 0.54 | 3.68 | 0.67 | 0.59 | 1.91 | 1.91 | 2.34 | 1.06 | 0.67 | 0.32 | 0.49 | 2.58 |
| 77-39 | 33E 2 (F77T,T39I) | 0.70 | 0.35 | 0.51 | 4.35 | 0.67 | 0.53 | 2.39 | 2.39 | 4.01 | 1.20 | 1.12 | 0.50 | 0.67 | 3.74 |
| 89-148 | 50 E7 (K89E, S148T) | 2.62 | 0.76 | 1.04 | 3.34 | 1.21 | 1.24 | 2.76 | 2.76 | 4.62 | 2.49 | 2.89 | 2.61 | 2.58 | 3.71 |
| 90-77 | 02D10 (I90V,F77T) | 1.55 | 0.60 | 0.82 | 13.12 | 1.08 | 0.84 | 6.71 | 6.71 | 30.62 | 1.77 | 8.13 | 4.09 | 12.85 | 20.94 |
| 106-164 | 17E 6 (M106K,C164S) | 1.65 | 1.06 | 1.11 | 1.32 | 1.27 | 1.29 | 1.98 | 1.98 | 1.77 | 1.82 | 2.58 | 4.79 | 1.60 | 2.16 |
| 23-58-169 | 47G12 (E23K,V58L,A169V) | 0.05 | 0.42 | 0.46 | 1.16 | 0.62 | 0.79 | 0.84 | 0.84 | 1.54 | 0.30 | 0.02 | 0.03 | 0.12 | 1.32 |
| 33-76-89 | 17C5 (K33N,I76N,K89E) | 1.11 | 0.59 | 1.48 | 0.93 | 1.89 | 1.79 | 1.30 | 1.30 | 1.13 | 1.56 | 0.74 | 0.32 | 0.65 | 0.99 |
| 68-90-145 | 04D10 (F68S,I90V,P145L) | 3.91 | 1.33 | 1.45 | 5.59 | 1.74 | 1.99 | 6.12 | 6.12 | 8.68 | 4.09 | 3.86 | 3.64 | 6.08 | 8.66 |
| 59-109-113-136 | 41H10 (I59T, Y109F, P113T, L136M) | 0.06 | 0.07 | 0.24 | 0.03 | 0.26 | 0.20 | 0.25 | 0.25 | 0.30 | 0.16 | 5.44 | 2.21 | 0.43 | 0.36 |

| POSITION | Clone(AA sequence) | coel. | h,h | PBI-3945 |
|---|---|---|---|---|
| 15 | 03F2 (G15R) | 0.002 | 0.010 | 0.024 |
| 18 | 40H11 (Q18L) | 0.38 | 0.53 | 0.39 |
| 20 | 16C5 (Q20R) | 2.58 | 0.82 | 0.80 |
| 22 | 14C1 (L22I) | 0.12 | 0.33 | 0.44 |
| 27 | 11E8 (L27V) | 0.21 | 1.20 | 1.30 |
| 54 | 18F8 (F54S) | 0.59 | 0.25 | 0.03 |
| 54 | 29H7 (F54I) | 6.20 | 0.65 | 1.29 |
| 58 | 30E4 (V58I) | 0.18 | 0.69 | 0.77 |
| 72 | 04G7 (L72Q) | 4.19 | 1.01 | 1.49 |
| 75 | 28B2 (M75K) | 4.11 | 2.21 | 2.06 |
| 77 | 18C4 (F77T) | 0.93 | 0.74 | 0.33 |
| 77 | 42E4 (F77C) | 0.08 | 0.75 | 0.28 |
| 77 | 50D12 (F77T) | 0.81 | 0.64 | 0.29 |
| 89 | 35D11 (K89E) | 2.18 | 0.88 | 0.61 |
| 90 | 10F2 (I90T) | 1.45 | 0.38 | 0.32 |
| 92 | 04A12 (L92H) | 0.62 | 0.27 | 0.03 |
| 109 | 43F9 (Y109F) | 0.22 | 0.54 | 0.07 |
| 127 | 30D6 (V127A) | 0.11 | 0.22 | 0.19 |
| 139 | 27B8 (D139G) | 0.00 | 0.08 | 0.01 |
| 164 | 25A1 (C164S) | 0.56 | 0.61 | 0.63 |
| 14-89 | 25F2 (A14V,K89E) | 1.91 | 0.66 | 0.49 |
| 27-33 | 47D8 (L27M,K33N) | 0.40 | 1.24 | 1.12 |
| 49-72 | 26F1 (E49K,L72Q) | 1.17 | 1.08 | 1.14 |
| 54-66 | 48G3 (F54I,S66T) | 6.17 | 0.66 | 1.31 |
| 54-67 | 35B8 (F54S,G67S) | 0.13 | 0.99 | 0.24 |
| 55-117 | 05H8 (D55G,I117F) | 0.11 | 0.30 | 0.30 |
| 56-93 | 46A11 (I56V,H93R) | 0.15 | 0.64 | 0.26 |
| 68-75 | 04E2 (F68S,M75K) | 4.11 | 1.78 | 1.94 |
| 77-126 | 27B9 (F77T,T126R) | 0.49 | 0.47 | 0.13 |
| 77-39 | 33E2 (F77T,T39I) | 0.58 | 0.44 | 0.20 |
| 89-148 | 50E7 (K89E,S148T) | 2.06 | 0.85 | 0.59 |
| 90-77 | 02D10 (I90V,F77T) | 1.85 | 1.01 | 0.56 |
| 106-164 | 17E6 (M106K,C164S) | 2.16 | 1.30 | 1.35 |
| 23-58-169 | 47G12 (E23K,V58L,A169V) | 0.04 | 0.37 | 0.47 |
| 33-76-89 | 17C5 (K33N,I76N,K89E) | 1.31 | 1.75 | 0.60 |
| 68-90-145 | 04D10 (F68S,I90V,P145L) | 3.01 | 1.11 | 1.07 |
| 59-109-113-136 | 41H10 (I59T,Y109F,P113T,L136M) | 0.05 | 0.20 | 0.02 |

FIG. 6D

| Clone | 18 | 20 | 54 | 59 | 72 | 77 | 89 | 92 | 109 | 113 | 127 | 136 | 164 |
|---|---|---|---|---|---|---|---|---|---|---|---|---|---|
| QC#1 (Q20R, L92H, F77C) |  | x |  |  |  | x |  | x |  |  |  |  |  |
| QC#3 (F77C) |  |  |  |  |  | x |  |  |  |  |  |  |  |
| QC#5 (L92H) |  |  |  |  |  |  |  | x |  |  |  |  |  |
| QC#6 (F54I, F77C) |  |  | x |  |  | x |  |  |  |  |  |  |  |
| QC#7 (Q20R, F54I, F77C) |  | x | x |  |  | x |  |  |  |  |  |  |  |
| QC#8 (Q20R, F54I) |  | x | x |  |  |  |  |  |  |  |  |  |  |
| QC#9 (F54I, F77C, L92H) |  |  | x |  |  | x |  | x |  |  |  |  |  |
| QC#10 (Q20R, F54I, F77C, L92H) |  | x |  |  |  | x |  | x |  |  |  |  |  |
| QC#13 (Q20R, Y109F) |  | x |  |  |  |  |  |  | x |  |  |  |  |
| QC#14 (L92H, Y109F) |  |  |  |  |  |  |  | x | x |  |  |  |  |
| QC#15 (Y109F) |  |  |  |  |  |  |  |  | x |  |  |  |  |
| QC#16 (F54I, L92H, Y109F) |  |  | x |  |  |  |  | x | x |  |  |  |  |
| QC#20 (F54I, Y109F) |  |  | x |  |  |  |  |  | x |  |  |  |  |
| QC#22 (Q18L, L92H, Y109F) | x |  |  |  |  |  |  | x | x |  |  |  |  |
| QC#27 (Q18L, F54I, L92H, Y109F) | x |  | x |  |  |  |  | x | x |  |  |  |  |
| QC#32 (Q18L, I59T, L92H, Y109F, P113T, V127A, K136M) | x |  |  | x |  |  |  | x | x | x | x | x |  |
| QC#36 (Q20R,F54I,L72Q, K89E, C164S) |  | x | x |  | x |  | x |  |  |  |  |  | x |
| QC#37 (F54I, L72Q, K89E, C164S) |  |  | x |  | x |  | x |  |  |  |  |  | x |
| QC#38 (F54I, C164S) |  |  | x |  |  |  |  |  |  |  |  |  | x |
| QC #1 C2 (Q18L, Y109F) | x |  |  |  |  |  |  |  | x |  |  |  |  |
| QC #1 B4 (Q18L, F54I) | x |  | x |  |  |  |  |  |  |  |  |  |  |
| QC #1 C3 (Q18L, F54I, Y109F) | x |  | x |  |  |  |  |  | x |  |  |  |  |
| QC#1 A7 (F54I, K89E, C164S) |  |  | x |  |  |  | x |  |  |  |  |  | x |
| QC#1 A11 (Q20R, F54I, L72Q, K89E) |  | x | x |  | x |  | x |  |  |  |  |  |  |
| QC#1 B9 Q20R,F54I,L72Q, C164S) |  | x | x |  | x |  |  |  |  |  |  |  | x |
| QC#1 D11 (F54I,L72Q,K89E,C164S) |  |  | x |  | x |  | x |  |  |  |  |  | x |

FIG. 7

| Sample | coelenterazine | h | h,h | PBI-3840 | PBI-3925 | PBI-3912 |
|---|---|---|---|---|---|---|
| QC#1 (Q20R, L92H, F77C) | 0.17 | 0.03 | 0.19 | 0.74 | 1.03 | 0.56 |
| QC#3 (F77C) | 0.09 | 0.36 | 0.89 | 0.16 | 1.06 | 0.04 |
| QC#5 (L92H) | 0.73 | 0.04 | 0.38 | 4.49 | 6.92 | 5.64 |
| QC#6 (F54I, F77C) | 0.85 | 0.59 | 0.91 | 1.89 | 3.80 | 0.41 |
| QC#7 (Q20R, F54I, F77C) | 0.72 | 0.22 | 0.20 | 1.85 | 2.83 | 1.50 |
| QC#8 (Q20R, F54I) | 6.48 | 0.89 | 0.34 | 11.73 | 21.51 | 35.04 |
| QC#9 (F54I, F77C, L92H) | 0.39 | 0.07 | 0.16 | 0.81 | 1.58 | 0.64 |
| QC#10 (Q20R, F54I, F77C, L92H) | 0.27 | 0.05 | 0.07 | 0.75 | 2.24 | 1.53 |
| QC#13 (Q20R, Y109F) | 0.21 | 0.07 | 0.25 | 1.08 | 1.74 | 4.18 |
| QC#14 (L92H, Y109F) | 0.06 | 0.00 | 0.08 | 0.78 | 1.84 | 2.63 |
| QC#15 (Y109F) | 0.21 | 0.15 | 0.54 | 0.95 | 0.68 | 0.46 |
| QC#16 (F54I, L92H, Y109F) | 0.35 | 0.02 | 0.05 | 1.01 | 3.73 | 8.75 |
| QC#20 (F54I, Y109F) | 4.49 | 0.82 | 0.51 | 9.41 | 12.43 | 10.39 |
| QC#22 (Q18L, L92H, Y109F) | 0.05 | 0.01 | 0.05 | 0.15 | 0.06 | 0.14 |
| QC#27 (Q18L, F54I, L92H, Y109F) | 0.08 | 0.01 | 0.10 | 0.68 | 0.59 | 1.06 |
| QC#32 (Q18L, I59T, L92H, Y109F, P113T, V127A, K136M) | 0.003 | 0.001 | 0.007 | 0.022 | 0.015 | 0.020 |
| QC#36 (Q20R,F54I, L72Q, K89E, C164S) | 0.99 | 0.14 | 0.06 | 1.34 | 1.86 | 16.93 |
| QC#37 (F54I, L72Q, K89E, C164S) | 2.01 | 0.30 | 0.14 | 3.16 | 4.63 | 23.45 |
| QC#38 (F54I, C164S) | 3.39 | 0.65 | 0.48 | 5.25 | 4.56 | 9.48 |
| C1A4E | 1.00 | 1.00 | 1.00 | 1.00 | 1.00 | 1.00 |

FIG. 8A

| Sample | Coel. | h | h,h | 2-me | PBI-3889 | PBI-3939 | PBI-3933 | PBI-3932 | PBI-3946 | PBI-3841 | PBI-3896 | PBI-3925 |
|---|---|---|---|---|---|---|---|---|---|---|---|---|
| QC#1 (Q20R, L92H, F77C) | 0.13 | 0.02 | 0.11 | 1.62 | 0.15 | 0.12 | 0.45 | 3.87 | 0.18 | 0.25 | 0.17 | 0.58 |
| QC#3 (F77C) | 0.07 | 0.25 | 0.55 | 1.14 | 0.63 | 0.38 | 0.41 | 1.79 | 0.28 | 0.04 | 0.04 | 0.55 |
| QC#5 (L92H) | 0.51 | 0.03 | 0.24 | 4.99 | 0.23 | 0.10 | 1.68 | 2.88 | 0.80 | 25.89 | 23.26 | 3.28 |
| QC#6 (F54I, F77C) | 0.69 | 0.48 | 0.67 | 22.92 | 0.31 | 0.07 | 0.51 | 35.10 | 0.44 | 0.08 | 0.15 | 2.55 |
| QC#7 (Q20R, F54I, F77C) | 0.54 | 0.18 | 0.15 | 22.57 | 0.09 | 0.03 | 0.39 | 32.08 | 0.21 | 0.39 | 0.41 | 2.24 |
| QC#8 (Q20R, F54I) | 5.32 | 0.79 | 0.28 | 28.12 | 0.49 | 0.11 | 2.80 | 40.88 | 1.43 | 26.40 | 43.55 | 17.18 |
| QC#9 (F54I, F77C, L92H) | 0.26 | 0.05 | 0.10 | 3.69 | 0.13 | 0.09 | 0.55 | 5.63 | 0.22 | 0.21 | 0.23 | 1.03 |
| QC#10 (Q20R, F54I, F77C, L92H) | 0.20 | 0.03 | 0.05 | 5.91 | 0.07 | 0.05 | 0.45 | 11.18 | 0.19 | 0.54 | 0.45 | 1.58 |
| QC#13 (Q20R, Y109F) | 0.26 | 0.10 | 0.31 | 1.05 | 0.37 | 0.29 | 0.66 | 3.37 | 0.25 | 19.06 | 74.46 | 1.82 |
| QC#14 (L92H, Y109F) | 0.10 | 0.003 | 0.11 | 1.18 | 0.11 | 0.06 | 0.52 | 2.24 | 0.07 | 13.47 | 65.50 | 1.64 |
| QC#15 (Y109F) | 0.29 | 0.22 | 0.74 | 0.38 | 0.83 | 0.69 | 0.68 | 0.74 | 0.47 | 6.43 | 1.61 | 0.89 |
| QC#16 (F54I, L92H, Y109F) | 0.44 | 0.02 | 0.06 | 6.00 | 0.11 | 0.06 | 0.46 | 9.48 | 0.03 | 5.53 | 269.14 | 3.50 |
| QC#20 (F54I, Y109F) | 4.22 | 0.90 | 0.50 | 5.86 | 1.19 | 0.61 | 3.68 | 14.10 | 1.82 | 44.89 | 15.18 | 12.45 |
| QC#22 (Q18L, L92H, Y109F) | 0.06 | 0.01 | 0.06 | 0.06 | 0.06 | 0.05 | 0.05 | 0.03 | 0.01 | 14.10 | 242.95 | 0.04 |
| QC#27 (Q18L, F54I, L92H, Y109F) | 0.13 | 0.02 | 0.12 | 0.33 | 0.15 | 0.12 | 0.30 | 0.24 | 0.10 | 0.60 | 561.32 | 0.40 |
| QC#32 (Q18L, I59T, L92H, Y109F, P113T, V127A, K136M) | 0.004 | 0.001 | 0.011 | 0.01 | 0.01 | 0.01 | 0.01 | 0.01 | 0.00 | 16.29 | 51.72 | 0.02 |
| QC#36 (Q20R,F54I, L72Q, K89E, C164S) | 0.78 | 0.14 | 0.07 | 23.49 | 0.02 | 0.002 | 0.09 | 28.30 | 0.06 | 64.90 | 49.30 | 2.04 |
| QC#37 (F54I, L72Q, K89E, C164S) | 1.87 | 0.32 | 0.17 | 26.86 | 0.08 | 0.01 | 0.32 | 33.42 | 0.22 | 71.56 | 37.60 | 5.30 |
| QC#38 (F54I, C164S) | 4.51 | 0.92 | 0.67 | 11.22 | 0.49 | 0.06 | 1.15 | 12.46 | 1.13 | 22.07 | 11.03 | 6.46 |
| C1A4E | 1.00 | 1.00 | 1.00 | 1.00 | 1.00 | 1.00 | 1.00 | 1.00 | 1.00 | 1.00 | 1.00 | 1.00 |

FIG. 8B

| Sample | Coel | h,h | PBI-3939 | PBI-3945 | PBI-3840 | PBI-3932 | PBI-3925 | PBI-9894 | PBI-3896 |
|---|---|---|---|---|---|---|---|---|---|
| QC C2 (Q18L, Y109F) | 0.01 | 0.06 | 0.04 | 0.04 | 0.03 | 0.01 | 0.01 | 19.87 | 24.80 |
| QC B4 (Q18L, F54I) | 5.71 | 1.84 | 1.23 | 1.19 | 6.04 | 8.23 | 7.02 | 67.35 | 719.58 |
| QC C3 (Q18L, F54I, Y109F) | 0.18 | 0.52 | 0.65 | 0.22 | 0.49 | 0.13 | 0.46 | 407.08 | 454.48 |
| QC E6 (Q18L, I59T, Y109F, P113T, V127A, K136M) | 0.0004 | 0.01 | 0.01 | 0.002 | 0.01 | 0.01 | 0.00 | 3.88 | 9.03 |
| QC A7 (F54I, K89E, C164S) | 2.63 | 0.21 | 0.01 | 0.28 | 4.05 | 17.21 | 4.86 | 11.82 | 23.95 |
| QC A11 (Q20R, F54I, L72Q, K89E) | 3.76 | 0.13 | 0.02 | 0.31 | 3.21 | 94.34 | 15.76 | 46.29 | 127.88 |
| QC B9 Q20R, F54I, L72Q, C164S) | 1.67 | 0.10 | 0.005 | 0.10 | 1.89 | 25.28 | 3.37 | 13.58 | 42.27 |
| QC D11 (F54I, L72Q, K89E, C164S | 1.95 | 0.13 | 0.01 | 0.16 | 2.45 | 27.69 | 4.84 | 13.38 | 33.69 |
| QC#6 (F54I, F77C) | 0.67 | 0.76 | 0.06 | 0.36 | 1.24 | 39.37 | 3.14 | 0.52 | 1.32 |
| QC#7 (Q20R, F54I, F77C) | 0.51 | 0.15 | 0.03 | 0.07 | 1.01 | 32.09 | 2.26 | 1.67 | 1.30 |
| QC#9 (F54I, F77C, L92H) | 0.22 | 0.10 | 0.09 | 0.06 | 0.33 | 4.97 | 1.01 | 0.26 | 0.32 |
| QC#8 (Q20R, F54I) | 6.37 | 0.35 | 0.14 | 0.93 | 8.42 | 46.87 | 21.22 | 13.40 | 33.57 |
| QC#13 (Q20R, Y109F) | 0.18 | 0.26 | 0.25 | 0.02 | 0.79 | 2.54 | 1.58 | 6.85 | 49.23 |
| QC#14 (L92H, Y109F) | 0.04 | 0.07 | 0.04 | 0.001 | 0.29 | 1.35 | 1.43 | 4.53 | 37.03 |
| QC#16 (F54I, L92H, Y109F) | 0.30 | 0.05 | 0.05 | 0.01 | 0.46 | 7.07 | 3.42 | 19.64 | 157.70 |
| QC#20 (F54I, Y109F) | 4.25 | 0.56 | 0.62 | 1.04 | 6.93 | 13.08 | 11.84 | 8.73 | 10.47 |
| QC#22 (Q18L, L92H, Y109F) | 0.04 | 0.05 | 0.04 | 0.01 | 0.09 | 0.03 | 0.05 | 38.41 | 138.45 |
| QC#27 (Q18L, I59T, L92H, Y109F, P113T, V127A, K136M) | 0.07 | 0.08 | 0.10 | 0.01 | 0.28 | 0.17 | 0.42 | 392.98 | 283.85 |
| QC#32 (Q18L, I59T, L92H, Y109F, P113T, V127A, K136M) | 0.003 | 0.01 | 0.01 | 0.0002 | 0.02 | 0.01 | 0.02 | 11.79 | 33.46 |
| QC#36 (Q20R, F54I, L72Q, K89E, C164S) | 0.92 | 0.06 | 0.002 | 0.05 | 1.07 | 24.56 | 2.12 | 10.40 | 35.04 |

FIG. 9

| Clone | 18 | 20 | 54 | 71 | 77 | 90 | 92 | 109 | 127 |
|---|---|---|---|---|---|---|---|---|---|
| QC#2 1 (Q20R,F77C,I90V,L92H,V127A) |  | x |  |  | x | x | x |  | x |
| QC#2 2 (Q20R,G71D,F77C,I90V,L92H,V127A) |  | x |  | x | x | x | x |  | x |
| QC#2 3 (Q20R,G71D,F77C,L92H,V127A) |  | x |  | x | x |  | x |  | x |
| QC#2 6 (F54I,G71D,F77C,L92H,V127A) |  |  | x | x | x |  | x |  | x |
| QC#2 7 (F54I,G71D,F77C,I90V,L92H) |  |  | x | x | x | x | x |  |  |
| QC#2 8 (F54I,G71D,F77C,I90V,L92H,V127A) |  |  | x | x | x | x | x |  | x |
| QC#2 11 (Q20R,F54I,G71D,F77C,I90V,L92H,V127A) |  | x | x | x | x | x | x |  | x |
| QC#2 16 (G71D,I90V,L92H,Y109F,L127A) |  |  |  | x |  | x | x | x | x |
| QC#2 18 (G71D,L92H,Y109F,L127A) |  |  |  | x |  |  | x | x | x |
| QC#2 21(Q20R,F54I,G71D,F77C,I90V,L92H,V127A) |  | x | x | x | x | x | x |  | x |
| QC#2 26 (Q18L,G71D,F77Y,I90V,L92H,Y109F,V127A) | x |  |  | x | x | x | x | x | x |
| QC#2 31 (Q18L,F54I,G71D,F77Y,I90V,L92H,Y109F,V127A) | x |  | x | x | x | x | x | x | x |
| QC#2 41 (G71D,F77C,I90V,L92H,V127A) |  |  |  | x | x | x | x |  | x |
| QC#2 44 (G71D,F77C,I90V,V127A) |  |  |  | x | x | x |  |  | x |
| QC#2 A3 (Q20R,G71D,F77C,L92H) |  | x |  | x | x |  | x |  |  |
| QC#2 C6 (F54I,G71D,F77C,L92H) |  |  | x | x | x |  | x |  |  |
| QC#2 A7 (Q20R,F54I,G71D,F77C,L92H,V127A) |  | x | x | x | x |  | x |  | x |
| QC#2 C10 (I90V,L92H,Y109F,V127A) |  |  |  |  |  | x | x | x | x |
| QC#2 E1 (F54I,F77Y,I90V,L92H,Y109F,V127A) |  |  | x |  | x | x | x | x | x |
| QC#2 E2 (F54I,G71D,I90V,L92H,Y109F) |  |  | x | x |  | x | x | x |  |
| QC#2 E4 (Q18L,F54I,G71D,F77Y,L92H,Y109F,V127A) | x |  | x | x | x |  | x | x | x |
| QC#2 F4(Q18L,F54I,F77Y,I90V,L92H,Y109F,V127A) | x |  | x |  | x | x | x | x | x |
| QC#2 E7 (Q18L,F54I,F77Y,I90V,L92H,Y109F,V127A) | x |  | x |  | x | x | x | x | x |
| QC#2 E8 (Q18L,F54I,I90V,L92H,Y109F,V127A) | x |  | x |  |  | x | x | x | x |
| QC#2 F7 (Q18L,F54I,G71D,F77Y,L92H,Y109F,V127A) | x |  | x | x | x |  | x | x | x |
| QC#2 H11 (G71D,F77C) |  |  |  | x | x |  |  |  |  |
| LE1 (I90V/L92H) |  |  |  |  |  | x | x |  |  |
| LE2 (I90V/Y109F) |  |  |  |  |  | x |  | x |  |
| LE3 (I90V/L92H/Y109F) |  |  |  |  |  | x | x | x |  |

FIG. 10

| Sample | Coel | h,h | PBI-3939 | PBI-3945 | PBI-3840 | PBI-3932 | PBI-3925 | PBI-3894 | PBI-3896 |
|---|---|---|---|---|---|---|---|---|---|
| QC#2 1 (Q20R,F77C,I90V,L92H,V127A) | 0.04 | 0.04 | 0.05 | 0.004 | 0.17 | 4.04 | 0.62 | 0.19 | 0.13 |
| QC#2 2 (Q20R,G71D,F77C,I90V,L92H,V127A) | 0.07 | 0.05 | 0.07 | 0.01 | 0.24 | 6.19 | 0.98 | 0.26 | 0.20 |
| QC#2 3 (Q20R,G71D,F77C,L92H,V127A) | 0.09 | 0.07 | 0.09 | 0.01 | 0.30 | 5.02 | 0.88 | 0.34 | 0.21 |
| QC#2 6 (F54J,G71D,F77C,L92H,V127A | 0.11 | 0.07 | 0.08 | 0.03 | 0.19 | 2.43 | 0.51 | 0.15 | 0.11 |
| QC#2 7 (F54J,G71D,F77C,I90V,L92H) | 0.40 | 0.11 | 0.12 | 0.09 | 0.39 | 13.65 | 2.15 | 0.38 | 0.41 |
| QC#2 8 (F54J,G71D,F77C,I90V,L92H,V127A) | 0.11 | 0.06 | 0.08 | 0.03 | 0.16 | 4.12 | 0.68 | 0.15 | 0.18 |
| QC#2 11 (Q20R,F54J,G71D,F77C,I90V,L92H,V127A) | 0.10 | 0.03 | 0.05 | 0.02 | 0.17 | 6.66 | 1.11 | 0.40 | 0.24 |
| QC#2 16 (G71D,I90V,L92H,Y109F,L127A,) | 0.11 | 0.06 | 0.04 | 0.001 | 0.29 | 1.49 | 1.51 | 7.72 | 55.11 |
| QC#2 18 (G71D,L92H,Y109F,V127A) | 0.08 | 0.04 | 0.03 | 0.0005 | 0.28 | 1.33 | 1.29 | 7.30 | 48.97 |
| QC#2 21(Q20R,F54J,G71D,F77C,I90V,L92H,V127A) | 0.27 | 0.02 | 0.02 | 0.004 | 0.31 | 7.57 | 2.49 | 30.02 | 160.54 |
| QC#2 26 (Q18L,G71D,F77Y,I90V,L92H,Y109F,V127A) | 0.00 | 0.01 | 0.01 | 0.001 | 0.00 | 0.01 | 0.02 | 1.38 | 7.86 |
| QC#2 31 (Q18L,F54J,G71D,F77Y,I90V,L92H,Y109F,V127A) | 0.01 | 0.03 | 0.03 | 0.004 | 0.01 | 0.05 | 0.06 | 8.04 | 77.32 |
| QC#2 41 (G71D,F77C,I90V,L92H,V127A) | 0.05 | 0.07 | 0.08 | 0.01 | 0.12 | 2.50 | 0.37 | 0.10 | 0.07 |
| QC#2 44 (G71D,F77C,I90V,V127A) | 0.17 | 0.15 | 0.15 | 0.03 | 0.15 | 2.92 | 0.41 | 0.18 | 0.10 |
| QC#2 A3 (Q20R,G71D,F77C,L92H) | 0.23 | 0.20 | 0.22 | 0.03 | 0.52 | 6.75 | 1.11 | 0.39 | 0.24 |
| QC#2 C6 (F54J,G71D,F77C,L92H) | 0.44 | 0.18 | 0.18 | 0.13 | 0.60 | 12.27 | 2.43 | 0.50 | 0.30 |
| QC#2 A7 (Q20R,F54J,G71D,F77C,L92H,V127A) | 0.13 | 0.05 | 0.06 | 0.02 | 0.28 | 6.93 | 1.25 | 0.32 | 0.22 |
| QC#2 C10 (I90V,L92H,Y109F,V127A) | 0.06 | 0.04 | 0.02 | 0.0004 | 0.22 | 1.08 | 1.05 | 4.33 | 34.52 |
| QC#1 E1 (F54J,I90V,L92H,Y109F,V127A) | 0.18 | 0.04 | 0.03 | 0.004 | 0.25 | 2.74 | 1.66 | 6.96 | 49.09 |
| QC#1 E2 (F54J,G71D,I90V,L92H,Y109F) | 0.39 | 0.06 | 0.04 | 0.01 | 0.24 | 9.71 | 3.63 | 25.77 | 185.63 |
| QC#2 E4 (Q18L,G71D,F77Y,I90V,L92H,Y109F,V127A) | 0.0005 | 0.009 | 0.008 | 0.0005 | 0.001 | 0.009 | 0.004 | 0.58 | 3.48 |
| QC#2 F4(Q18L,F77Y,I90V,L92H,Y109F,V127A) | 0.0002 | 0.0057 | 0.0062 | 0.00003 | 0.0013 | 0.0069 | 0.0048 | 0.56 | 4.18 |
| QC#2 E7 (Q18L,F54J,F77Y,I90V,L92H,Y109F,V127A) | 0.003 | 0.013 | 0.015 | 0.002 | 0.006 | 0.020 | 0.024 | 3.17 | 36.43 |
| QC#2 E8 (Q18L,F54J,I90V,L92H,Y109F,V127A) | 0.06 | 0.04 | 0.05 | 0.002 | 0.13 | 0.05 | 0.11 | 145.44 | 331.26 |
| QC#2 F7 (Q18L,F54J,G71D,F77Y,L92H,Y109F,V127A) | 0.01 | 0.03 | 0.03 | 0.004 | 0.01 | 0.03 | 0.04 | 3.22 | 30.50 |
| QC#2 H11 (G71D,F77C) | 0.07 | 0.69 | 0.61 | 0.24 | 0.13 | 3.46 | 1.02 | 0.16 | 0.10 |
| C1A4E | 1.00 | 1.00 | 1.00 | 1.00 | 1.00 | 1.00 | 1.00 | 1.00 | 1.00 |

FIG. 11

| Sample | Coel. | hh | PBI-3939 | PBI-3945 | PBI-3889 | PBI-3840 | PBI-3932 | PBI-3925 | PBI-3894 | PBI-3896 | PBI-3897 |
|---|---|---|---|---|---|---|---|---|---|---|---|
| C1A4E | 1 | 1 | 1 | 1 | 1 | 1 | 1 | 1 | 1 | 1 | 1 |
| I90V | 1.49 | 0.77 | 1.21 | 0.51 | 1.12 | 2.86 | 22.13 | 14.69 | 8.48 | 2.30 | 6.43 |
| Y109F | 0.13 | 0.42 | 0.35 | 0.15 | 0.42 | 0.58 | 0.37 | 0.41 | 1.05 | 0.35 | 12.70 |
| LE2 (I90V, Y109F) | 0.31 | 0.29 | 0.26 | 0.06 | 0.33 | 1.80 | 10.20 | 6.09 | 5.15 | 3.04 | 60.24 |
| QC #27 (Q18L/L92H/Y109F/F54I) | 0.15 | 0.06 | 0.08 | 0.01 | 0.06 | 0.23 | 0.12 | 0.20 | 196.86 | 140.68 | 13.83 |
| QC#2 E7 (Q18L,F54I,F77Y,I90V,L92H,Y109F,V127A) | 0.002 | 0.02 | 0.02 | 0.0022 | 0.0076 | 0.0054 | 0.02 | 0.02 | 1.83 | 6.57 | 31.17 |
| QC#2 F4 (Q18L,F77Y,I90V,L92H,Y109F,V127A) | 0.0008 | 0.005 | 0.0046 | 0.0004 | 0.0021 | 0.0021 | 0.01 | 0.05 | 0.24 | 0.80 | 7.04 |
| QC#1 A11 (Q20R, F54I, L72Q, K89E) | 3.50 | 0.12 | 0.02 | 0.16 | 0.08 | 3.51 | 82.84 | 11.19 | 59.12 | 24.00 | 42.51 |

FIG. 12

| Sample | POSITION | Sequence | COELENTERAZINE | H,H | PBI-3897 | PBI-3896 | PBI-3894 |
|---|---|---|---|---|---|---|---|
| 29H3 | 18 | L18I | 1.17 | 0.32 | 0.94 | 2.37 | 3.25 |
| 25A11 | 21 | V21L | 0.06 | 0.11 | 0.53 | 0.55 | 0.19 |
| 4F3 | 67 | G67S | 1.75 | 0.63 | 1.37 | 1.24 | 1.06 |
| 24B12 | 68 | F68Y | 1.88 | 0.88 | 1.52 | 1.62 | 1.44 |
| 29C4 | 72 | L72Q | 1.69 | 0.77 | 1.37 | 2.33 | 2.38 |
| 3H11 | 75 | M75K | 2.33 | 1.09 | 1.90 | 2.19 | 1.90 |
| 3F10 | 76 | I76F | 0.50 | 0.81 | 1.27 | 0.17 | 0.08 |
| 27E4 | 90 | I90T | 0.24 | 0.17 | 0.76 | 0.10 | 0.04 |
| 1B6 | 92 | H92R | 0.10 | 0.46 | 0.98 | 0.06 | 0.02 |
| 47H12 | 22-74 | L22F-E74K | 0.03 | 0.12 | 0.29 | 0.02 | 0.03 |
| 11F10 | 158-1 | F1I,V158I | 2.49 | 2.53 | 2.37 | 1.67 | 1.40 |
| 48D5 | 11-109 | R11Q,F109Y | 6.24 | 2.74 | 0.39 | 1.04 | 0.17 |
| 18A8 | 18-98 | L18I, V98F | 0.64 | 0.19 | 0.54 | 1.25 | 1.56 |
| 43G9 | 21-106 | V21M,M106I | 0.02 | 0.04 | 0.05 | 0.23 | 0.49 |
| 33A5 | 31-102 | F31I,V102M | 0.73 | 0.68 | 0.67 | 1.06 | 1.16 |
| 11G9 | 32-92 | Q32H,H92R | 0.10 | 0.47 | 1.02 | 0.06 | 0.01 |
| 9D7 | 45-76 | V45E,I76V | 1.66 | 0.71 | 1.33 | 1.72 | 1.80 |
| 33H2 | 92-159 | H92R,T159S | 0.05 | 0.37 | 0.58 | 0.04 | 0.01 |
| 1G5 | 92-170 | H92R,G170R | 0.58 | N/A | 1.50 | 0.16 | 0.31 |
| 19C10 | 18-49-86 | L18Q,E49D,H86R | 3.29 | 0.15 | 0.52 | 0.05 | 0.05 |
| 44H1 | 21-47-51 | V21M, S47P, G51E | 0.01 | 0.02 | 0.02 | 0.10 | 0.22 |
| 14C2 | 46-106-168 | L46Q, M106I, L168F | 1.77 | 0.97 | 1.52 | 1.51 | 1.33 |
| 24D7 | 48-99-76 | G48R,I99V,I76F | 0.38 | 0.63 | 1.04 | 0.10 | 0.05 |
| 18E 8 | 55-92-96 | D55E,H92Q,T96A | 1.40 | 3.78 | 2.41 | 0.39 | 0.36 |
| 7D9 | 74-92-99 | E74I,H92R,I99T | 0.14 | 0.36 | 0.77 | 0.04 | 0.01 |
| 8C2 | 21-68-69-142 | V21M,F68L,Q69H,L142V | 0.01 | 0.02 | 0.02 | 0.11 | 0.22 |
| QC #27 HT7 | | | 1.00 | 1.00 | 1.00 | 1.00 | 1.00 |

| Positions in common with C1A4E library |
|---|
| 18 |
| 22 |
| 68 |
| 72 |
| 75 |
| 90 |
| 92 |
| 106 |
| 109 |

FIG. 13

| Sequence | Clone | 21 | 68 | 72 | 75 | 76 | 90 | 92 | 158 |
|---|---|---|---|---|---|---|---|---|---|
| F68Y, L72Q, M75K, V158I | QC27#1 | | x | x | x | | | | x |
| I90T, H92R | QC27#2 | | | | | | x | x | |
| F68Y, L72Q, M75K, I90T, H92R, V158I | QC27#3 | | x | x | x | | x | x | x |
| V21L, I76F, I90T, H92R | QC27#4 | x | | | | x | x | x | |
| V21L, I76F | QC27#6A | x | | | | x | | | |
| V21L, F68Y, L72Q, M75K, I90T | QC27#7A | x | x | x | x | | x | | |
| V21L, I76F, H92R | QC27#8 | x | | | | x | | x | |
| V21L, F68Y, L72Q, M75K, H92R, V158I | QC27#9A | x | x | x | x | | | x | x |
| V21L, F68Y, L72Q, M75K, I76F, I90T, H92R, V158I | QC27#10 | x | x | x | x | x | x | x | x |
| F68Y, L72Q, M75K, H92R | QC27#12A | | x | x | x | | | x | |
| V21L, H92R | QC27#13 | x | | | | | | x | |
| F68Y, L72Q, M75K, H92R, V158I | QC27#14A | | x | x | x | | | x | x |
| V21L, F68Y, L72Q, M75K, I90T, H92R, V158I | QC27#5 | x | x | x | x | | x | x | x |
| V21L, I90T, I76F | QC27#6 | x | | | | x | x | | |
| V21L, F68Y, L72Q, M75K, I76F, V158I | QC27#9B | x | x | x | x | x | | | x |

FIG. 14

| Sample | AA change | Coelenterazine | h,h | PBI-3897 | PBI-3841 | PBI-3896 | PBI-3894 |
|---|---|---|---|---|---|---|---|
| QC27 #1 | F68Y, L72Q, M75K, V158I | 2.59 | 3.95 | 2.90 | 2.90 | 5.19 | 6.72 |
| QC27 #2 | I90T, H92R | 0.0189 | 0.17 | 0.19 | 0.19 | 0.02 | 0.00 |
| QC27 #3 | F68Y, L72Q, M75K, V158I, I90T, H92R | 0.1212 | 0.77 | 0.88 | 0.92 | 0.10 | 0.02 |
| QC27 #4 | V21L, I76F, I90T, H92R | 0.0006 | 0.00 | 0.06 | 0.08 | 0.04 | 0.00 |
| QC27 #6A | V21L,I76F | 0.0060 | 0.07 | 0.26 | 0.20 | 0.12 | 0.03 |
| QC27 #7A | V21L,F68Y,L72Q,M75K,I90T | 0.0370 | 0.40 | 1.76 | 1.54 | 1.09 | 0.16 |
| QC27 #8 | V21L,I76F,H92R | 0.0730 | 0.21 | 0.50 | 0.59 | 0.28 | 0.11 |
| QC27 #9A | V21L,F68Y,L72Q,M75K,H92R,V158I | 0.0041 | 0.08 | 0.81 | 1.35 | 0.32 | 0.03 |
| QC27 #10 | V21L,F68Y,L72Q,M75K,I76F,I90T,H92R,V158I | 0.0049 | 0.01 | 0.33 | 0.48 | 0.20 | 0.02 |
| QC27 #12A | F68Y,L72Q,M75K,H92R | 0.2767 | 2.64 | 2.82 | 3.17 | 0.31 | 0.09 |
| QC27 #13 | V21L,H92R | 0.0007 | 0.01 | 0.12 | 0.20 | 0.05 | 0.00 |
| QC27 #14A | F68Y,L72Q,M75K,H92R,V158I | 0.2283 | 2.38 | 2.51 | 2.71 | 0.26 | 0.07 |
| QC27 #5 | V21L,F68Y,L72Q,M75K,I90T,H92R,V158I | 0.0013 | 0.02 | 0.15 | 0.25 | 0.07 | 0.01 |
| QC27 #6 | V21L,I90T,I76F | 0.0014 | 0.00 | 0.09 | 0.05 | 0.03 | 0.00 |
| QC27 #9B | V21L,F68Y,L72Q,M75K,I76F,V158I | 0.0530 | 0.43 | 1.14 | 1.19 | 0.93 | 0.32 |
| QC27 ctrl. | | 1 | 1 | 1 | 1 | 1 | 1 |

FIG. 15

| Sample | Position | AA change | Coelenterazine | H | HH | PBI-3841 | PBI-3897 |
|---|---|---|---|---|---|---|---|
| 30D12 | 22 | L22F | 0.08 | 0.01 | 0.08 | 0.28 | 0.26 |
| 26D4 | 36 | V36M | 1.70 | 1.40 | 2.19 | 1.21 | 1.08 |
| 40B10 | 76 | I76F | 3.66 | 0.54 | 0.57 | 1.65 | 1.97 |
| 5C3 | 128 | T128A | 0.19 | 0.26 | 0.45 | 0.43 | 0.47 |
| 22C2 | 128-154 | T128S,T154S | 0.24 | 0.33 | 0.52 | 0.43 | 0.46 |
| 22G9 | 135-152 | N135Y,R152H | 0.09 | 0.13 | 0.16 | 0.20 | 0.24 |
| 39H11 | 18-145 | L18I,P145Q | 42.10 | 3.20 | 18.30 | 2.51 | 2.37 |
| 36C11 | 18-99 | L18V,I99T | 125.68 | 2.64 | 24.99 | 2.15 | 2.17 |
| 3E2 | 67-159 | G67D,T159I | 0.39 | 0.51 | 0.63 | 0.77 | 0.80 |
| 48C5 | 46-51-138 | L46Q,G51R,I138S | 0.43 | 0.49 | 0.96 | 0.87 | 0.95 |
| 3C10 | 51-112-113 | G51V,R112C,P113H | 0.24 | 0.31 | 0.72 | 0.93 | 0.67 |
| QC279a HT | | | 1 | 1 | 1 | 1 | 1 |

FIG. 16

| Sample | Position | AA change | Coelenterazine | h,h | PBI-3939 | PBI-3945 | PBI-3889 | PBI-4002 |
|---|---|---|---|---|---|---|---|---|
| IVY 29H12 | 19 | D19N | 0.002 | 0.03 | 0.04 | 0.15 | 0.03 | 0.11 |
| IVY 47E11 | 20 | Q20P | 0.054 | 1.05 | 1.36 | 1.22 | 1.22 | 1.12 |
| IVY 36E11 | 38 | V38I | 0.169 | 0.96 | 1.26 | 1.18 | 1.23 | 1.09 |
| IVY 21D1 | 44 | I44F | 0.128 | 0.67 | 0.65 | 0.39 | 0.73 | 0.38 |
| IVY 5B8 | 76 | I76N | 0.208 | 0.32 | 0.39 | 0.50 | 0.36 | 0.44 |
| IVY 50G8 | 77 | Y77N | 0.141 | 0.86 | 0.23 | 0.61 | 0.62 | 0.85 |
| IVY 27E6 | 95 | G95S | 0.106 | 0.73 | 0.70 | 0.61 | 0.78 | 0.62 |
| IVY 2G6 | 95 | G95D | 0.004 | 0.07 | 0.07 | 0.33 | 0.06 | 0.30 |
| IVY 27B7 | 110 | F110I | 0.022 | 0.13 | 0.18 | 0.44 | 0.17 | 0.37 |
| IVY 26H7 | 149 | L149I | 0.266 | 0.94 | 0.82 | 0.90 | 0.89 | 0.94 |
| IVY 21A4 | 152 | R152S | 0.242 | 0.78 | 0.83 | 0.63 | 0.99 | 0.60 |
| IVY 5C2 | 38-43 | V38F,K43N | 0.008 | 0.45 | 0.51 | 0.56 | 0.46 | 0.51 |
| IVY 43D3 | 49-32 | E49G,Q32P | 0.170 | 0.93 | 1.23 | 1.15 | 1.20 | 1.07 |
| IVY 20E12 | 60-119 | I60V,V119M | 0.289 | 0.38 | 0.44 | 0.62 | 0.43 | 0.57 |
| IVY 26B6 | 18-69-124 | Q18H,Q69H,K124M | 0.006 | 0.29 | 0.39 | 0.29 | 0.40 | 0.26 |
| IVY 23F3 | 33-43-94 | K33N,K43N,Y94F | 0.004 | 0.24 | 0.25 | 0.34 | 0.21 | 0.34 |
| IVY+HT7 | | | 1.00 | 1.00 | 1.00 | 1.00 | 1.00 | 1.00 |

FIG. 18

| Sample | position | AA | Coef. | H | H₂H | PBI-3939 | PBI-3945 | PBI-3889 | PBI-4002 |
|---|---|---|---|---|---|---|---|---|---|
| 34B9 | 18 | Q18L | 0.22 | 0.52 | 0.74 | 0.92 | 0.38 | 1.12 | 0.48 |
| 8E3 | 27 | L27V | 0.19 | 1.06 | 1.12 | 1.35 | 1.17 | 1.33 | 1.11 |
| 33C4 | 28 | S28Y | 0.07 | 0.83 | 0.80 | 0.78 | 0.88 | 0.83 | 0.80 |
| 21C5 | 33 | K33N | 0.96 | 1.41 | 1.68 | 1.68 | 1.36 | 1.74 | 1.34 |
| 25F10 | 36 | V36E | 0.14 | 0.39 | 0.46 | 0.40 | 0.36 | 0.60 | 0.41 |
| 25H7 | 40 | P40T | 0.008 | 0.13 | 0.27 | 0.47 | 0.28 | 0.46 | 0.23 |
| 28A8 | 135 | N135D | 0.04 | 0.50 | 0.69 | 0.73 | 0.51 | 0.86 | 0.47 |
| 44G12 | 155 | I155T | 0.08 | 0.51 | 0.85 | 0.63 | 0.48 | 0.87 | 0.48 |
| 46A6 | 32-6 | F6Y,Q32L | 0.12 | 0.61 | 0.76 | 0.75 | 0.57 | 0.80 | 0.56 |
| 26D5 | 18-51-86 | Q18L,G51R,H86L | 0.47 | 0.95 | 1.39 | 1.58 | 0.62 | 1.95 | 0.83 |
| 3E12 | 6-42-50 | F6Y,Q42H,N50K | 0.12 | 0.60 | 0.84 | 1.03 | 0.61 | 1.04 | 0.61 |

FIG. 19

| Sequence | Sample | 19 | 20 | 27 | 32 | 38 | 43 | 49 | 58 | 77 | 95 | 110 | 149 |
|---|---|---|---|---|---|---|---|---|---|---|---|---|---|
| Q20P,Q32P,E49G,L149I | C1.1 | | X | | X | | | X | | | | | X |
| Q20P,Q32P,E49G,F77Y,G95D,F110I,L149I | C4.13 | | X | | X | | | X | | X | X | X | X |
| Q20P,L27V,V38I,L149I | C5.16 | | X | X | | X | | | | | | | X |
| L27V,V38I,L149I | C5.19 | | X | X | | X | | | | | | | X |
| D19N,Q20P,V38I,L149I | C7.26 | X | | | | X | | | | | | | X |
| V38I,G95D,F110I,L149I | C8.28 | | | | | X | | | | | | | X |
| D19N,Q20P,V38I,G95D,F110I,L149I | C8.29 | X | X | | | X | | | | | X | X | X |
| L27V,V38F,K43N,L149I | C11.40 | | | X | | X | X | | | | | | X |
| L27V,V38F,K43N,V58I,L149I | C11.42 | | X | X | | X | X | | X | | X | X | X |
| L27V,V38F,K43N,V58I,F110I,L149I | C12.46 | | X | X | | | X | | X | | | X | X |
| Q20P,L27V,L149I | C13.50 | | X | X | | | | | | | | | X |
| Q20P,L27V,V38I,F110I | C14.51 | | X | X | | X | | | | | | X | |
| L27V,V38I,F110I,L149I | C14.52 | | X | X | | X | | | | | | X | X |

FIG. 20

| Sample | Sequence | Coelenterazine | H | H,H | PBI-3939 | PBI-3945 | PBI-4002 | PBI-3932 | PBI-3840 |
|---|---|---|---|---|---|---|---|---|---|
| C1.1 | Q20P,Q32P,E49G,L149I | 0.00006 | 0.00026 | 0.00033 | 0.00069 | 0.00050 | 0.00051 | 0.00014 | 0.00008 |
| C4.13 | Q20P,Q32P,E49G,F77Y,G95D,F110I,L149I | 0.00006 | 0.00008 | 0.00009 | 0.00008 | 0.00005 | 0.00006 | 0.00013 | 0.00010 |
| C5.16 | Q20P,L27V,V38I,L149I | 0.0002 | 0.0013 | 0.0003 | 0.0011 | 0.0034 | 0.0036 | 0.0001 | 0.0001 |
| C5.19 | L27V,V38I,L149I | 0.0010 | 0.2747 | 0.0663 | 0.1595 | 0.5082 | 0.5129 | 0.0015 | 0.0003 |
| C7.26 | D19N,Q20P,V38I,L149I | 0.0001 | 0.0017 | 0.0011 | 0.0020 | 0.0032 | 0.0037 | 0.0001 | 0.0000 |
| C8.29 | D19N,Q20P,V38I,G95D,F110I,L149I | 0.000016 | 0.000025 | 0.000036 | 0.000016 | 0.000014 | 0.000031 | 0.000040 | 0.000025 |
| C11.40 | L27V,V38F,K43N,L149I | 0.00010 | 0.01172 | 0.00714 | 0.01853 | 0.04124 | 0.02485 | 0.00036 | 0.00006 |
| C11.42 | L27V,V38F,K43N,V58I,L149I | 0.0001 | 0.0016 | 0.0011 | 0.0044 | 0.0093 | 0.0040 | 0.0001 | 0.0001 |
| C12.46 | L27V,V38F,K43N,V58I,F110I,L149I | 0.00002 | 0.00004 | 0.00005 | 0.00001 | 0.00008 | 0.00006 | 0.00006 | 0.00004 |
| C13.50 | Q20P,L27V,L149I | 0.0001 | 0.0124 | 0.0036 | 0.0027 | 0.0109 | 0.0100 | 0.0001 | 0.0000 |
| C14.51 | Q20P,L27V,V38I,F110I | 0.00003 | 0.00010 | 0.00004 | 0.00001 | 0.00008 | 0.00011 | 0.00003 | 0.00004 |
| C14.52 | L27V,V38I,F110I,L149I | 0.00007 | 0.00041 | 0.00008 | 0.00006 | 0.00034 | 0.00046 | 0.00012 | 0.00008 |
| IVY-H7 | | 1 | 1 | 1 | 1 | 1 | 1 | 1 | 1 |

FIG. 21

| Sequence | clone | 6 | 18 | 27 | 28 | 33 | 34 | 36 | 40 | 50 | 51 | 135 | 155 |
|---|---|---|---|---|---|---|---|---|---|---|---|---|---|
| F6Y,Q18L,K33N,N135D | C1.1 | x | x | | | x | | | | | | x | |
| F6Y,Q18L,K33N,N135D,I155T | C1.2 | x | x | | | x | | | | | | x | x |
| F6Y,K33N,N135D,I155T | C1.3 | x | | | | | | | | | | x | x |
| K33N,P40T,N135D,I155T | C2.6 | | | | | x | | | x | | | x | x |
| F6Y,Q18L,K33N,P40T,N135D,I155T | C2.7 | x | x | | | x | | | x | | | x | x |
| F6Y,K33N,P40T,N135D,I155T | C2.8 | x | | | | x | | | x | | | x | x |
| F6Y,Q18L,K33N,V36E,P40T,N50S,G51RN135D,I155T | C3.13 | x | x | | | x | | x | x | x | x | x | x |
| F6Y,Q18L,N135D,I155T | C4.16 | x | x | | | | | | | | | x | x |
| Q18L,N135D,I155T | C4.17 | | x | | | | | | | | | x | x |
| F6Y,Q18L,L27V,S28Y,N135D,I155T | C4.18 | x | x | x | x | | | | | | | x | x |
| F6Y,Q18L,L27V,S28Y,P40T | C5.23 | x | x | x | x | | | | x | | | | |
| F6Y,Q18L,L27V,S28Y,K33N,V36E,N135D,I155T | C6.26 | x | x | x | x | x | | x | | | | x | x |
| F6Y,Q18L,L27V,S28Y,K33N,V36E,N135D,I155T | C6.28 | x | x | x | x | x | | x | | | | x | x |
| F6Y,Q18L,P40T,N135D,I155T | C7.31 | x | x | | | | | | x | | | x | x |
| F6Y,Q18L,L27V,S28Y,K33N,P40T,N135D,I155T | C7.33 | x | x | x | x | x | | | x | | | x | x |
| Q18L,P40T,N135D,I155T | C7.34 | | x | | | | | | x | | | x | x |
| F6Y,Q18L,K33M,L34M,N135D,I155T | C8.36 | x | x | | | x | x | | | | | x | x |
| Q18L,K33M,L34M,N135D,I155T | C8.38 | | x | | | x | x | | | | | x | x |
| F6Y,Q18L,K33M,L34M,I55T | C8.40 | x | x | | | x | x | | | | | | x |
| F6Y,Q18L,K33M,L34M,P40T,N135D | C9.44 | x | x | | x | | | | x | | | x | |
| F6Y,Q18L,L27V,S28Y,N50S,G51R,N135D | C10.46 | x | x | x | | | | | | x | x | x | |
| F6Y,Q18L,N50S,G51R,N135D,I155T | C10.48 | x | x | | | | | | | x | x | x | x |
| Q18L,N50S,G51R,N135D,I155T | C10.49 | | | | | | | | | x | x | x | x |
| Q18L,L27V,S28Y,N50S,G51R,N135D,I155T | C10.50 | x | x | x | x | | | | | x | x | x | x |
| F6Y,Q18L,L27V,S28Y,N50S,G51R,N135D,I155T | C11.54 | x | x | x | x | | | | | x | x | x | x |

FIG. 22

| Sample | Sequence | Coelenterazine | H | HH | PBI-3939 | PBI-3945 | PBI-3889 | PBI-4002 | PBI-3932 | PBI-3840 |
|---|---|---|---|---|---|---|---|---|---|---|
| C1.1 | F6Y,Q18L,K33N,N135D | 0.0055128 | 0.130 | 0.463 | 0.444 | 0.127 | 0.290 | 0.159 | 0.0083435 | 0.017 |
| C1.2 | F6Y,Q18L,K33N,N135D,I155T | 0.0000068 | 0.0015698 | 0.0043713 | 0.0066058 | 0.0013479 | 0.0027420 | 0.0009303 | 0.0000844 | 0.0000782 |
| C1.3 | F6Y,K33N,N135D,I155T | 0.0000257 | 0.0088297 | 0.036 | 0.048 | 0.0083438 | 0.023 | 0.0057396 | 0.0002600 | 0.0004430 |
| C2.6 | K33N,P40T,N135D,I155T | 0.0000009 | 0.0000288 | 0.0001711 | 0.0017877 | 0.0001365 | 0.0002859 | 0.0000858 | 0.0000035 | 0.0000025 |
| C2.7 | F6Y,Q18L,K33N,P40T,N135D,I155T | 0.0000008 | 0.0000091 | 0.0000318 | 0.0000611 | 0.0002445 | 0.0003744 | 0.0002560 | 0.0000013 | 0.0000020 |
| C2.8 | F6Y,K33N,P40T,N135D,I155T | 0.0000004 | 0.0000107 | 0.0000641 | 0.0007157 | 0.0000848 | 0.0001958 | 0.0000447 | 0.0000019 | 0.0000011 |
| C3.13 | F6Y,Q18L,K33N,V36E,P40T,N50S,G51R,N135D,I155T | 0.0000003 | 0.0000006 | 0.0000015 | 0.0000037 | 0.0000010 | 0.0000031 | 0.0000018 | 0.0000064 | 0.0000017 |
| C4.16 | F6Y,Q18L,N135D,I155T | 0.0000299 | 0.0046508 | 0.012 | 0.017 | 0.0052284 | 0.010 | 0.0037895 | 0.0000946 | 0.0002504 |
| C4.17 | Q18L,N135D,I155T | 0.0000222 | 0.0032164 | 0.0081703 | 0.011 | 0.0034948 | 0.0066376 | 0.0026060 | 0.0000717 | 0.0001691 |
| C4.18 | F6Y,Q18L,L27V,S28Y,N135D,I155T | 0.0000008 | 0.0000325 | 0.0001094 | 0.0003355 | 0.0001157 | 0.0001447 | 0.0000548 | 0.0000060 | 0.0000025 |
| C5.23 | F6Y,Q18L,L27V,S28Y,P40T | 0.0000579 | 0.0002759 | 0.0000464 | 0.0004978 | 0.0017611 | 0.0002812 | 0.0013044 | 0.0000144 | 0.0000132 |
| C6.26 | Q18L,L27V,S28Y,K33N,V36E,N135D,I155T | 0.0000055 | 0.0000276 | 0.0001950 | 0.0004882 | 0.0000838 | 0.0003453 | 0.0000663 | 0.0003772 | 0.0000586 |
| C6.28 | F6Y,Q18L,L27V,S28Y,K33N,V36E,N135D,I155T | 0.0000016 | 0.0000067 | 0.0000451 | 0.0001166 | 0.0000200 | 0.0000805 | 0.0000158 | 0.0000852 | 0.0000157 |
| C7.31 | F6Y,Q18L,P40T,N135D,I155T | 0.0000003 | 0.0000017 | 0.0000024 | 0.0000174 | 0.0000084 | 0.0000113 | 0.0000067 | 0.0000018 | 0.0000005 |
| C7.33 | F6Y,Q18L,L27V,S28Y,K33N,P40T,N135D,I155T | 0.0000004 | 0.0000007 | 0.0000013 | 0.0000017 | 0.0000008 | 0.0000011 | 0.0000006 | 0.0000016 | 0.0000009 |
| C7.34 | Q18L,P40T,N135D,I155T | 0.0000007 | 0.0000021 | 0.0000024 | 0.0000253 | 0.0000131 | 0.0000159 | 0.0000101 | 0.0000048 | 0.0000009 |
| C8.36 | F6Y,Q18L,K33M,L34M,N135D,I155T | 0.0000024 | 0.0000249 | 0.0000898 | 0.0001137 | 0.0000298 | 0.0000823 | 0.0000269 | 0.0000163 | 0.0000195 |
| C8.38 | Q18L,K33M,L34M,N135D,I155T | 0.0000047 | 0.0000956 | 0.0003420 | 0.0004501 | 0.0001128 | 0.0003207 | 0.0001027 | 0.0000476 | 0.0000710 |
| C8.40 | F6Y,Q18L,K33M,L34M,I155T | 0.0002632 | 0.010 | 0.015 | 0.018 | 0.011 | 0.015 | 0.0097703 | 0.0008447 | 0.0018540 |
| C9.44 | F6Y,Q18L,K33M,L34M,P40T,N135D | 0.0000041 | 0.0000139 | 0.0000153 | 0.0000379 | 0.0000423 | 0.0000474 | 0.0000534 | 0.0000284 | 0.0000486 |
| C10.46 | F6Y,Q18L,L27V,S28Y,N50S,G51R,N135D | 0.0002613 | 0.016 | 0.015 | 0.030 | 0.026 | 0.014 | 0.014 | 0.0044221 | 0.0002678 |
| C10.48 | F6Y,Q18L,N50S,G51R,N135D,I155T | 0.0000064 | 0.0005384 | 0.0011439 | 0.0016621 | 0.0006785 | 0.0010704 | 0.0004835 | 0.0001176 | 0.0000290 |
| C10.49 | Q18L,N50S,G51R,N135D,I155T | 0.0000184 | 0.0023853 | 0.0052253 | 0.0072753 | 0.0028335 | 0.0045995 | 0.0021987 | 0.0008853 | 0.0001334 |
| C10.50 | Q18L,L27V,S28Y,N50S,G51R,N135D,I155T | 0.0000095 | 0.0000547 | 0.0001427 | 0.0004411 | 0.0002044 | 0.0001929 | 0.0000965 | 0.0000697 | 0.0000099 |
| C11.54 | F6Y,Q18L,L27V,S28Y,N50S,G51R,N135D,I155T | 0.0000009 | 0.0000157 | 0.0000467 | 0.0001215 | 0.0000541 | 0.0000547 | 0.0000266 | 0.0000065 | 0.0000023 |

FIG. 23

| Sequence | clone | 1 | 4 | 18 | 27 | 33 | 38 | 68 | 70 | 72 | 75 | 102 |
|---|---|---|---|---|---|---|---|---|---|---|---|---|
| Q18L | 1D5 | | | x | | | | | | | | |
| F1I,L27V,V89I | 8A3 | x | | | x | | x | | | | | |
| F1I,L27V | 8A7 | x | | | x | | | | | | | |
| F1I,V89I | 8E2 | x | | | | | x | | | | | |
| L27V | 8F2 | | | | x | | | | | | | |
| M75K,L72Q,F68Y,Q18L | 9B8 | | | x | x | | | x | | x | x | |
| M75K,L72Q,F68Y,L27V,Q18L,V89I | 9F6 | | | x | x | x | x | x | | x | x | |
| F1I,M75K,L72Q,F68Y,L27V,V89I | 10A7 | x | | | x | x | x | x | | x | x | |
| F1I,M75K,L72Q,M70V,Q18L | 10G10 | x | | x | | | | | x | | | |
| K33N | 14A2 | | | | | x | | | | | | |
| F1I,M75K,L72Q,F68Y,K33N,M102E | 14C4 | x | | | | x | | x | | x | x | x |
| E4K,M75K,L72Q,F68Y,K33N | 15C1 | | x | | | x | | x | | x | x | |

FIG. 26

| Sample | Sequence | Coel. | H | HH | PBI-3939 | PBI-3945 | PBI-3889 | PBI-4002 |
|---|---|---|---|---|---|---|---|---|
| IV | | 1 | 1 | 1 | 1 | 1 | 1 | 1 |
| 1D6 | Q18L | 0.77 | 0.92 | 2.16 | 4.08 | 1.04 | 2.27 | 1.32 |
| 8A3 | F1I,L27V,V38I | 0.01 | 0.81 | 0.87 | 0.43 | 0.90 | 0.48 | 0.77 |
| 8A7 | F1I,L27V | 0.43 | 1.55 | 1.95 | 1.26 | 1.50 | 1.50 | 1.50 |
| 8E 2 | F1I,V38I | 0.13 | 0.53 | 0.61 | 0.75 | 0.60 | 0.64 | 0.51 |
| 8F2 | L27V | 0.40 | 1.54 | 1.87 | 1.06 | 1.53 | 1.37 | 1.49 |
| 9B8 | M75K,L72Q,F68Y,Q18L | 1.40 | 1.69 | 2.52 | 4.37 | 1.44 | 2.35 | 1.72 |
| 9F6 | M75K,L72Q,F68Y,L27V,Q18L,V38I | 0.09 | 2.05 | 1.67 | 1.11 | 1.98 | 1.04 | 1.62 |
| 10A7 | F1I,M75K,L72Q,F68Y,L27V,V38I | 0.08 | 1.40 | 1.17 | 0.82 | 1.74 | 0.89 | 1.23 |
| 10G10 | F1I,M75K,L72Q,F68Y,M70V,Q18L | 1.03 | 1.51 | 2.30 | 4.25 | 1.35 | 2.33 | 1.60 |
| 14A2 | K33N | 1.12 | 1.62 | 1.93 | 1.80 | 1.80 | 2.23 | 1.66 |
| 14C4 | F1I,M75K,L72Q,F68Y,K33N,V102E | 1.27 | 1.33 | 1.08 | 1.36 | 1.53 | 0.84 | 1.11 |
| 15C1 | E4K,M75K,L72Q,F68Y,K33N | 2.63 | 2.61 | 2.10 | 2.60 | 2.94 | 1.67 | 2.20 |

Native coelenterazine

| Amino acid | Relative activity |
|---|---|
| Ala | 1.0 |
| Phe | 3.2 |
| Lys | 19.2 |
| Arg | 26.8 |

B

Coelenterazine-h

| Amino acid | Relative activity |
|---|---|
| Ser | 1.1 |
| Ile | 1.4 |
| Lys | 11.6 |
| Arg | 15.9 |
| Phe | 55.9 |

C

PBI-3939

| Amino acid | Relative activity |
|---|---|
| Ser | 1.8 |
| Glu | 4.6 |
| Ile | 10.0 |
| Lys | 17.5 |
| Arg | 26.4 |
| Phe | 444.4 |

D

| Amino acid substitution | Relative activity (in context of wt OgLuc) | Relative activity (in context of N166R) |
|---|---|---|
| L27V | 62.2 | 45.4 |
| A33N | 0.6 | 1.3 |
| K43R | 1.1 | 17.1 |
| M75K | 65.7 | 467.7 |
| T39T | 118.6 | 1.5 |
| L72Q | 2.0 | 5.0 |
| F68D | 3.0 | 5.4 |

| Exp. system | RLUs Oluc/FLuc | RLUs OlucP/FLucP | S/B, Oluc | S/B, OlucP | S/B, FLuc | S/B, FLucP |
|---|---|---|---|---|---|---|
| 293/CRE | 22 | 22 | 224 | 1768 | 268 | 781 |
| 293/NFkB | 75 | 8 | 22 | 514 | 233 | 347 |
| Hela/NFkB | 14 | 2 | 40 | 47 | 54 | 44 |
| HepG2/NFkB | 267 | 5 | 7 | 11 | 11 | 19 |
| Jurkat/NFkB | 16 | 6 | 18 | 15 | 6 | 11 |
| Jurkat/CRE | 19 | 4 | 14 | 123 | 28 | 40 |
| ME180/CRE | 56 | 12 | 2 | 6 | 4 | 5 |
| ME180/NFkB | 149 | 21 | 7 | 19 | 7 | 25 |
| HCT116/NFkB | 22 | 16 | 10 | 605 | 4 | 47 |
| U2OS/NFkB | 114 | 16 | 15 | 18 | 11 | 20 |

| CP site ("CP#") | SEQ ID NOs: | response to TEV | CP site ("CP#") | SEQ ID NOs: | response to TEV | CP site ("CP#") | SEQ ID NOs: | response to TEV | CP site ("CP#") | SEQ ID NOs: | response to TEV |
|---|---|---|---|---|---|---|---|---|---|---|---|
| 5 | 114 and 115 | 1.3 | 53 | 160 and 161 | 2100 | 95 | 204 and 205 | 512.9 | 136 | 246 and 247 | / |
| 6 | 116 and 117 | 7.0 | 54 | 162 and 163 | 12.3 | 97 | 206 and 207 | 9.1 | 139 | 248 and 249 | 1.9 |
| 7 | 118 and 119 | / | 55 | 164 and 165 | 7744.3 | 98 | 447 and 448 | 5.4 | 140 | 250 and 251 | / |
| 9 | 120 and 121 | 2.2 | 56 | 166 and 167 | / | 100 | 208 and 209 | 7515.2 | 141 | 252 and 253 | / |
| 11 | 122 and 123 | / | 57 | 445 and 446 | 17.6 | 101 | 210 and 211 | 6329.9 | 142 | 254 and 255 | 5.3 |
| 12 | 124 and 125 | 1.6 | 58 | 168 and 169 | 116.7 | 102 | 212 and 213 | 3205.1 | 143 | 256 and 257 | 871.4 |
| 15 | 126 and 127 | / | 64 | 170 and 171 | 1.4 | 103 | 214 and 215 | 3456.8 | 144 | 258 and 259 | 1.6 |
| 18 | 128 and 129 | 2.1 | 67 | 172 and 173 | / | 104 | 216 and 217 | 3036.9 | 145 | 260 and 261 | 3.7 |
| 21 | 130 and 131 | / | 70 | 174 and 175 | / | 105 | 218 and 219 | 4931.6 | 146 | 262 and 263 | 6.6 |
| 24 | 132 and 133 | 3.8 | 73 | 176 and 177 | / | 106 | 220 and 221 | 5.3 | 147 | 264 and 265 | 2.0 |
| 27 | 134 and 135 | 3.1 | 76 | 178 and 179 | / | 109 | 222 and 223 | 12.3 | 148 | 266 and 267 | 3.8 |
| 34 | 136 and 137 | 9.3 | 79 | 180 and 181 | 1.3 | 112 | 224 and 225 | 82.7 | 149 | 268 and 269 | 4.4 |
| 40 | 138 and 139 | 1.8 | 80 | 182 and 183 | 1.3 | 13 | 443 and 444 | 160.8 | 150 | 270 and 271 | 867.4 |
| 43 | 140 and 141 | / | 81 | 184 and 185 | 1.5 | 115 | 226 and 227 | / | 151 | 272 and 273 | 6.3 |
| 44 | 142 and 143 | 12.9 | 82 | 186 and 187 | 1.5 | 120 | 228 and 229 | 1661 | 154 | 274 and 275 | / |
| 45 | 144 and 145 | 1057.7 | 83 | 188 and 189 | 1.2 | 121 | 230 and 231 | 1.5 | 156 | 276 and 277 | 942.1 |
| 46 | 146 and 147 | 1277.9 | 84 | 190 and 191 | 1.4 | 123 | 232 and 233 | 323.6 | 157 | 278 and 279 | 1467.9 |
| 47 | 148 and 149 | 1.5 | 85 | 192 and 193 | 1.2 | 124 | 234 and 235 | 1548.2 | 158 | 280 and 281 | 1526.5 |
| 48 | 150 and 151 | 6.7 | 86 | 194 and 195 | 1.4 | 125 | 236 and 237 | 1141.8 | 160 | 282 and 283 | 12.4 |
| 49 | 152 and 153 | 12.5 | 87 | 196 and 197 | 1.5 | 129 | 238 and 239 | 40.2 | 163 | 284 and 285 | / |
| 50 | 154 and 155 | 2.2 | 88 | 198 and 199 | 1.8 | 130 | 240 and 241 | 2,043.0 | 166 | 286 and 287 | / |
| 51 | 156 and 157 | 2.8 | 91 | 200 and 201 | 324.2 | 131 | 242 and 243 | 612.5 | | | |
| 52 | 158 and 159 | 15.9 | 94 | 202 and 203 | 5.5 | 133 | 244 and 245 | 1.5 | | | |

FIG. 73E

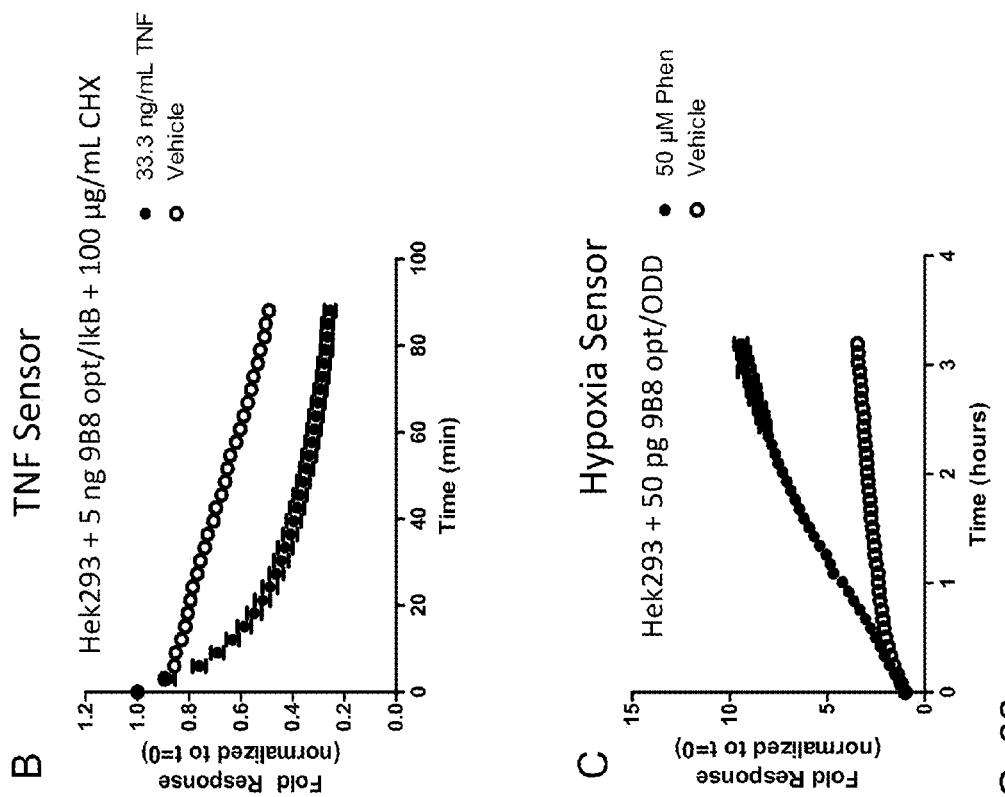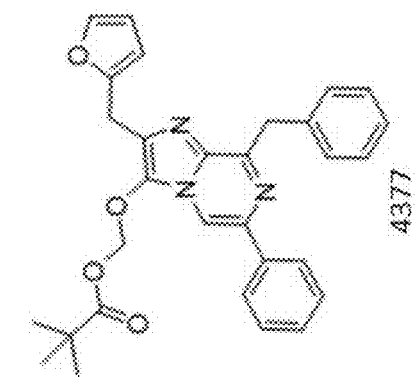
FIG. 82

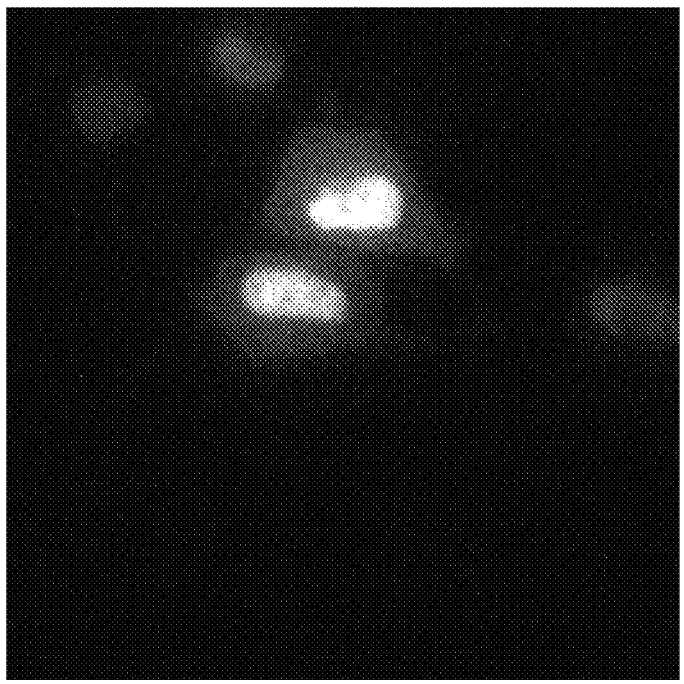
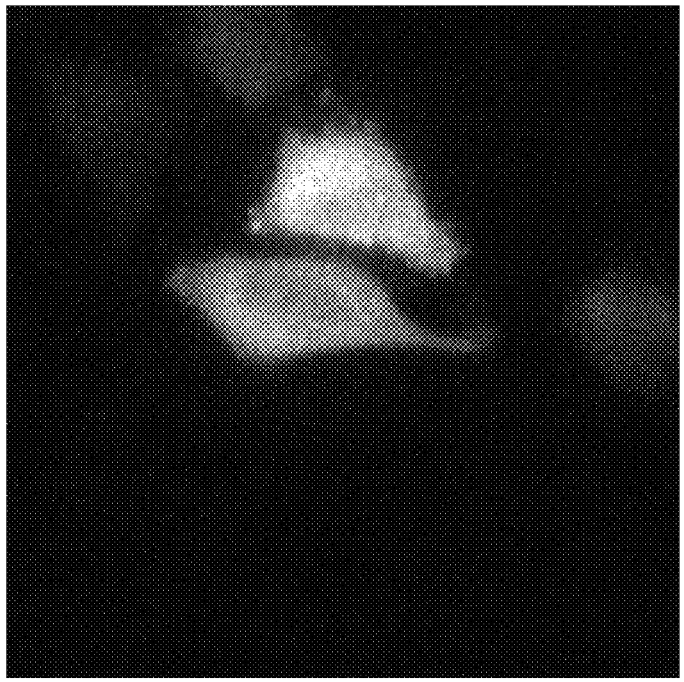
FIG. 90

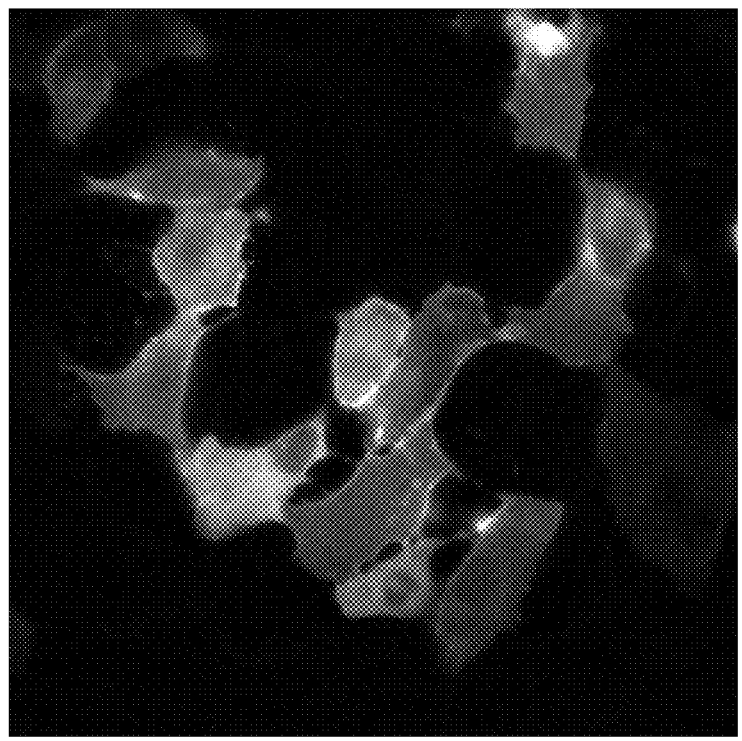
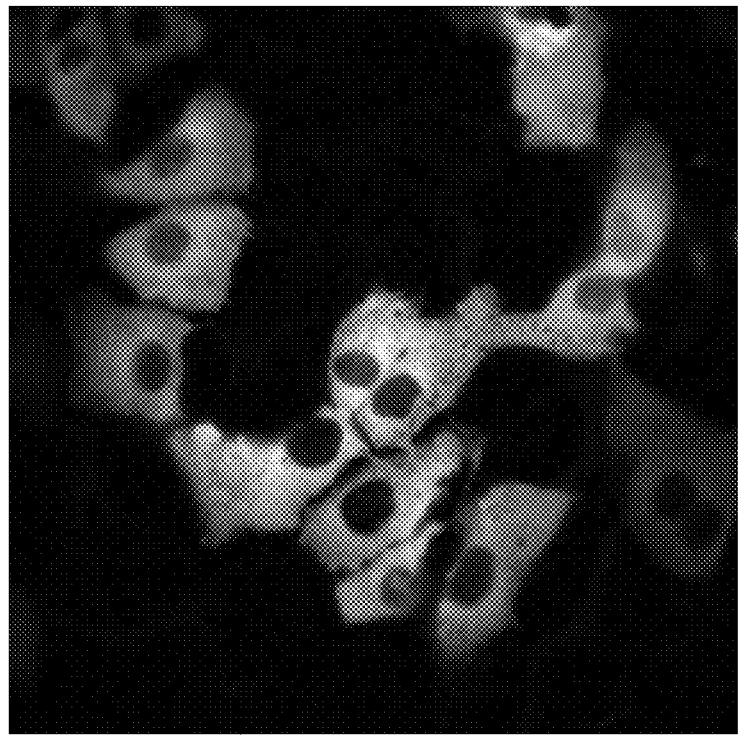
FIG. 91

OPLOPHORUS-DERIVED LUCIFERASES, NOVEL COELENTERAZINE SUBSTRATES, AND METHODS OF USE

CROSS REFERENCE TO RELATED APPLICATIONS

This application is a continuation of U.S. patent application Ser. No. 13/287,986, filed Nov. 2, 2011, which claims priority to U.S. Provisional Application No. 61/409,422, filed Nov. 2, 2010, which is incorporated herein by reference in its entirety.

BACKGROUND

The luciferase secreted from the deep-sea shrimp *Oplophorus gracilirostris* has been shown to possess many interesting characteristics, such as high activity, high quantum yield, and broad substrate specificity (including, e.g., coelenterazine as well as various coelenterazine analogs). The bioluminescent reaction of *Oplophorus* takes place when the oxidation of coelenterazine (substrate) with molecular oxygen is catalyzed by *Oplophorus* luciferase, resulting in light of maximum intensity at 462 nm and the products $CO_2$ and coelenteramide (Shimomura et al., *Biochemistry*, 17:994 (1978)). Optimum luminescence occurs at pH 9 in the presence of 0.05-0.1 M NaCl at 40° C., and, due to the unusual resistance of this enzyme to heat, visible luminescence occurs at temperatures above 50° C. when the highly purified enzyme is used or at over 70° C. when partially purified enzyme is used. At pH 8.7, the native luciferase was reported by Shimomura et al. (1978) to have a molecular weight of approximately 130 kDa, apparently comprising four monomers of 31 kDa each; at lower pH, the native luciferase tends to polymerize.

Later work has shown that the *Oplophorus gracilirostris* luciferase is a complex of native 35 kDa and 19 kDa proteins, i.e., a heterotetramer consisting of two 19 kDa components and two 35 kDa components. Inouye et al. (2000) reported the molecular cloning of the cDNAs encoding the 35 kDa and 19 kDa proteins of *Oplophorus* luciferase, and the identification of the protein component that catalyzes the luminescence reaction. The cDNAs encoding the proteins were expressed in bacterial and mammalian cells, and the 19 kDa protein was identified as the component capable of catalyzing the luminescent oxidation of coelenterazine (Inouye et al., 2000).

The 19 kDa protein of *Oplophorus* luciferase (GenBank accession BAB13776, 196 amino acids) appears to be the smallest catalytic component having luciferase function, and its primary structure has no significant similarity with any reported luciferase including imidazopyrazinone luciferases (Lorenz et al., *PNAS USA*, 88:4438 (1991); Thompson et al., *PNAS USA*, 86:6567 (1989)). Expression of the 19 kDa protein in *E. coli* resulted in the formation of inclusion bodies (Inouye and Sasaki, *Protein Expression and Purification*, 56:261-268 (2007)). The formation of inclusion bodies is likely due to the instability of the protein.

The substrate specificity of *Oplophorus* luciferase is unexpectedly broad (Inouye and Shimomura. *BBRC*, 223: 349 (1997)). For instance, bisdeoxycoelenterazine (i.e., coelenterazine-hh), an analog of coelenterazine, is an excellent substrate for *Oplophorus* luciferase comparable to coelenterazine (Nakamura et al., *Tetrahedron Lett.*, 38:6405 (1997)). Moreover, *Oplophorus* luciferase is a secreted enzyme, like the luciferase of the marine ostracod *Cypridina* (*Vargula*) *hilgendorfii* (Johnson and Shimomura, *Meth. Enzyme*, 57:331 (1978)), which also uses an imidazopyrazinone-type luciferin to emit light.

SUMMARY

In an aspect, the disclosure relates to a compound of formula (Ia) or (Ib):

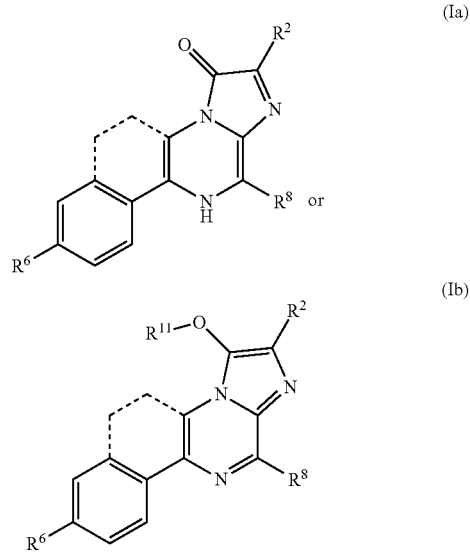

wherein $R^2$ is selected from the group consisting of

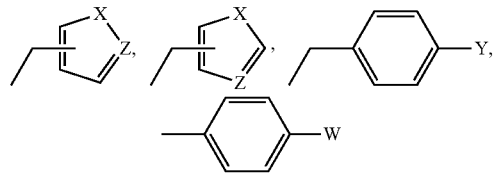

or $C_{2-5}$ straight chain alkyl;

$R^6$ is selected from the group consisting of —H, —OH, —NH$_2$, —OC(O)R or —OCH$_2$OC(O)R;

$R^8$ is selected from the group consisting of

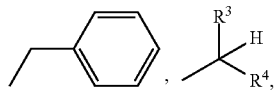

H or lower cycloalkyl;

wherein $R^3$ and $R^4$ are both H or both $C_{1-2}$ alkyl;

W is —NH$_2$, halo, —OH, —NHC(O)R, —CO$_2$R;

X is —S—, —O— or —NR$^{22}$—;

Y is —H, —OH, or —OR$^{11}$;

Z is —CH— or —N—;

each $R^{11}$ is independently —C(O)R" or —CH$_2$OC(O)R";

$R^{22}$ is H, CH$_3$ or CH$_2$CH$_3$;

each R is independently $C_{1-7}$ straight-chain alkyl or $C_{1-7}$ branched alkyl;

R" is $C_{1-7}$ straight-chain alkyl or $C_{1-7}$ branched alkyl;

the dashed bonds indicate the presence of an optional ring, which may be saturated or unsaturated;

with the proviso that when R² is
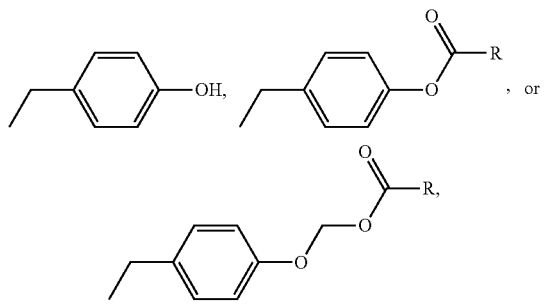, or
R⁸ is not
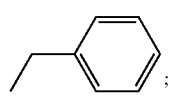;
with the proviso that when R² is
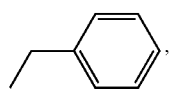,
R⁸ is
or lower cycloalkyl; and with the proviso that when R⁶ is NH₂, R² is,
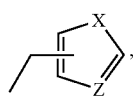
or C₂₋₅ alkyl;
or R⁸ is not
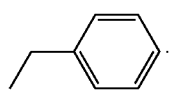.
In another aspect, the disclosure relates to a compound selected from
3882
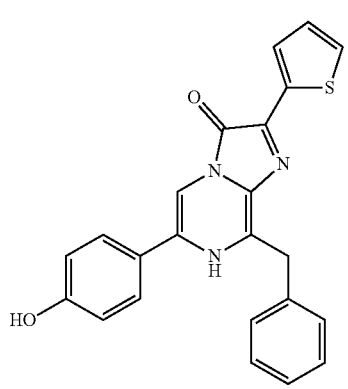
3881
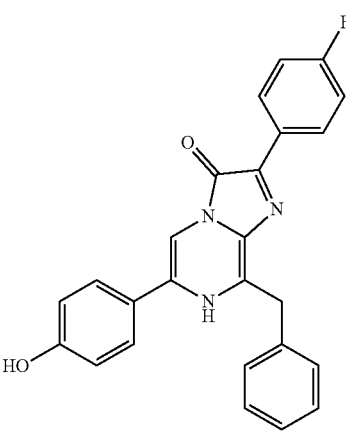
3899
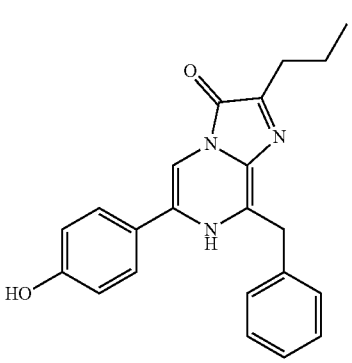
3900
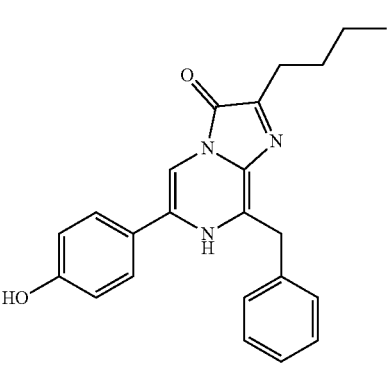

5
-continued
3945
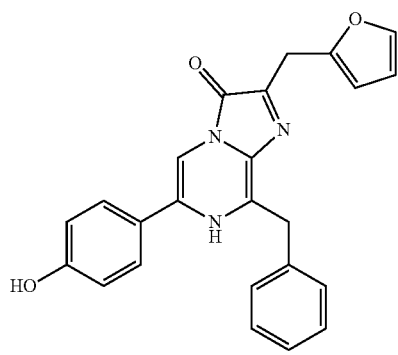
4002
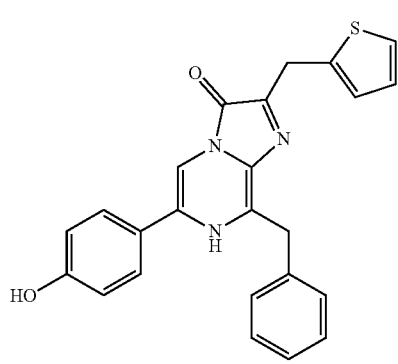
3840
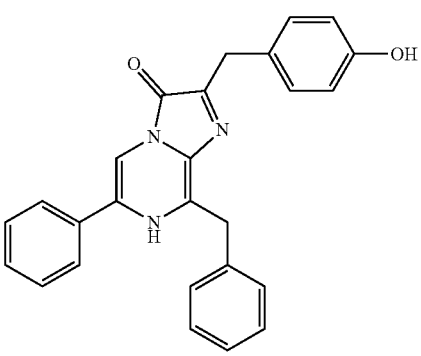
3886
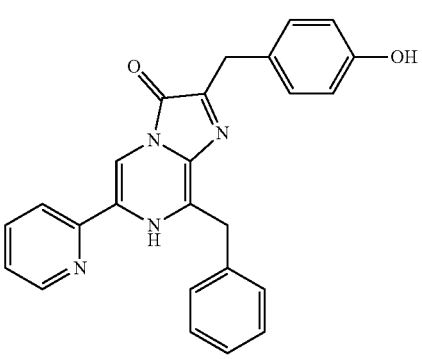
6
-continued
3857
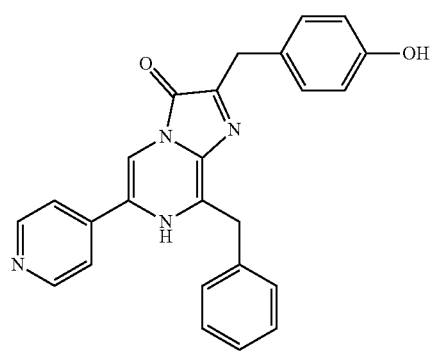
3887
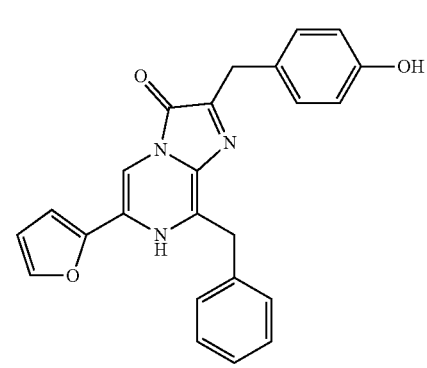
3913
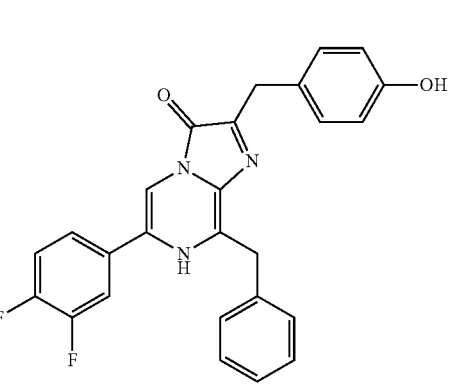
3932
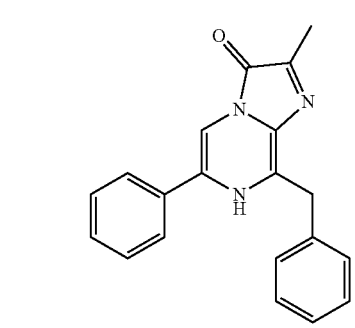

-continued
3925 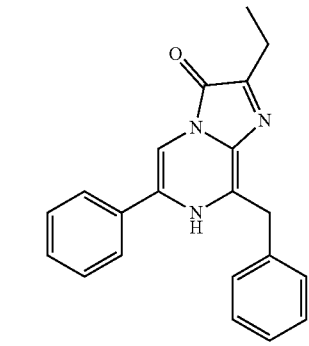
3933 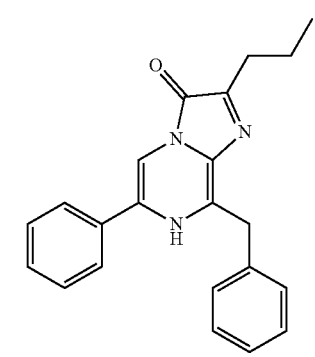
3946 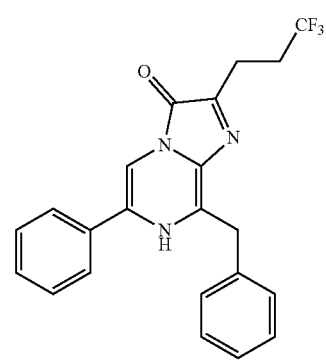
3889 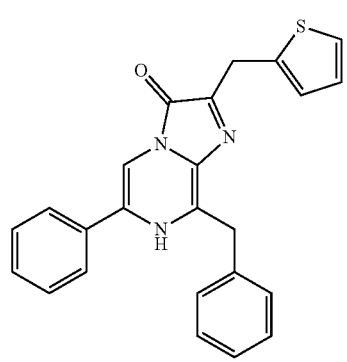
-continued
3939 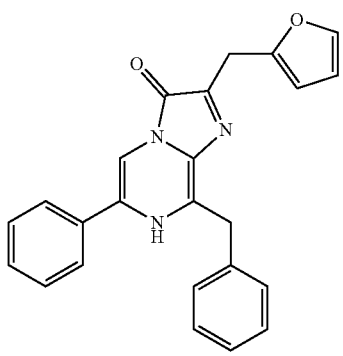
3894 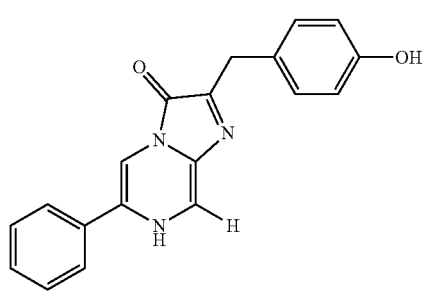
3896 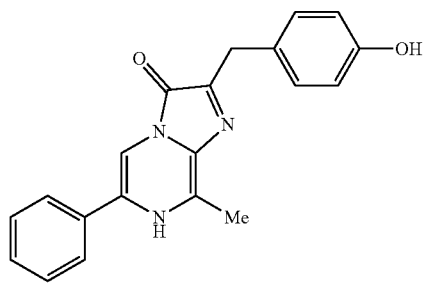
3897 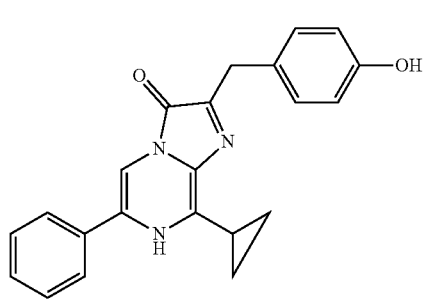
3841 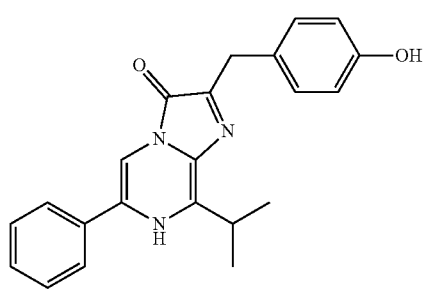

3842

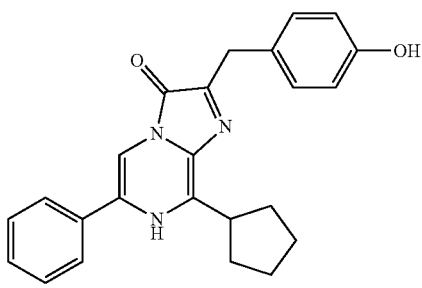

4525

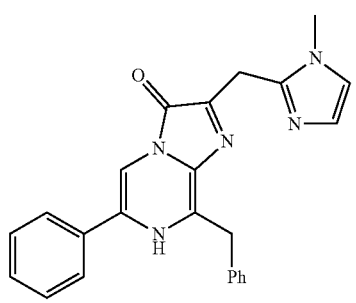

4540

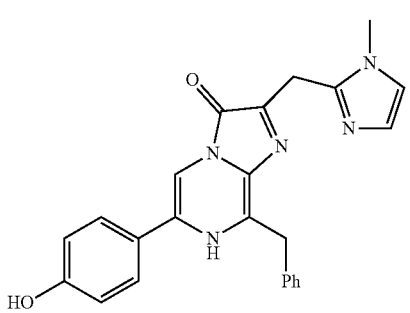

4541

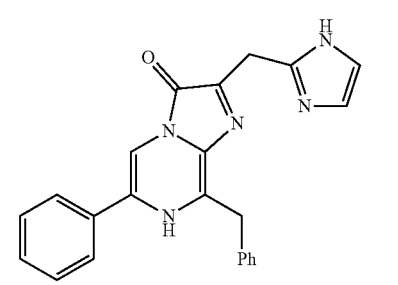

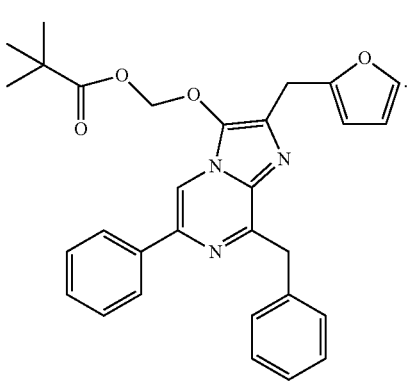

In an aspect, the disclosure relates to a compound of formula

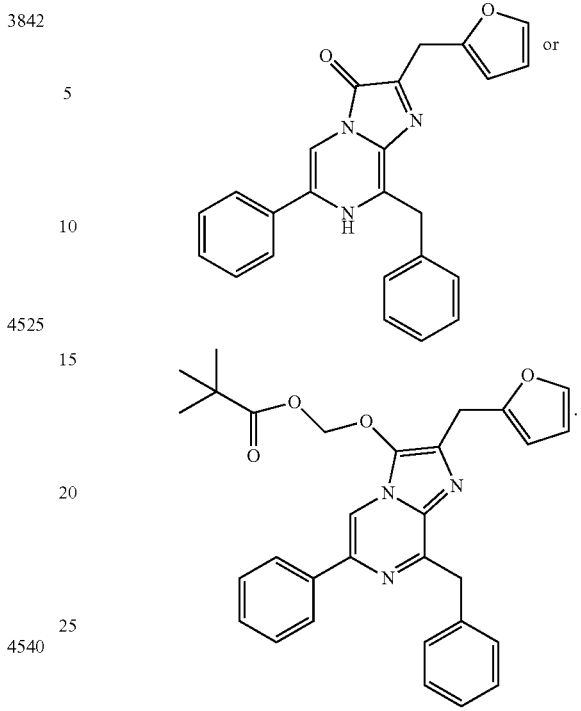

In an aspect, the disclosure relates to an isolated polynucleotide encoding an OgLuc variant polypeptide having at least 60% amino acid sequence identity to SEQ ID NO: 1 comprising at least one amino acid substitution at a position corresponding to an amino acid in SEQ ID NO: 1 wherein the OgLuc variant polypeptide has enhanced luminescence.

In an aspect, the disclosure relates to an isolated polynucleotide encoding an OgLuc variant polypeptide having at least 60% amino acid sequence identity to SEQ ID NO: 1 comprising at least one amino acid substitution at a position corresponding to an amino acid in SEQ ID NO: 1 wherein the OgLuc variant polypeptide has enhanced luminescence relative to an OgLuc polypeptide of SEQ ID NO: 3 with the proviso that the polypeptide encoded by the polynucleotide is not one of those listed in Table 47.

In an aspect, the disclosure relates to an isolated polynucleotide encoding an OgLuc variant polypeptide having at least 60% amino acid sequence identity to SEQ ID NO: 1 comprising at least one amino acid substitution at a position corresponding to an amino acid in SEQ ID NO: 1 wherein the OgLuc variant polypeptide has enhanced luminescence relative to a polypeptide of SEQ ID NO: 31 with the proviso that the polypeptide encoded by the polynucleotide is not SEQ ID NO: 3 or 15.

In an aspect, the disclosure relates to an isolated polynucleotide encoding an OgLuc variant polypeptide having at least 60% amino acid sequence identity to SEQ ID NO: 1 comprising at least one amino acid substitution at a position corresponding to an amino acid in SEQ ID NO: 1 wherein the OgLuc variant polypeptide has enhanced luminescence relative to a polypeptide of SEQ ID NO: 29 with the proviso that the polypeptide encoded by the polynucleotide is not SEQ ID NO: 3 or 15.

In an aspect, the disclosure relates to an isolated polynucleotide encoding an OgLuc variant polypeptide having at least 80% amino acid sequence identity to an OgLuc polypeptide of SEQ ID NO: 1 comprising amino acid substitutions A4E, Q11R, A33K, V44I, P115E, Q124K, Y138I, N166R, I90V, F54I, Q18L, F68Y, L72Q, and M75K corresponding to SEQ ID NO: 1 and the OgLuc variant polypeptide having luciferase activity.

In an aspect, the disclosure relates to an isolated polynucleotide encoding an OgLuc variant polypeptide having at least 80% amino acid sequence identity to an OgLuc polypeptide of SEQ ID NO: 1, wherein the amino acid at position 4 is glutamate, at position 11 is arginine, at position 18 is leucine, at position 33 is lysine, at position 44 is isoleucine, at position 54 is isoleucine, at position 68 is tyrosine, at position 72 is glutamine, at position 75 is lysine, at position 90 is valine, at position 115 is glutamate, at position 124 is lysine, at position 138 is isoleucine, and at position 166 is arginine corresponding to SEQ ID NO: 1 and the OgLuc variant polypeptide having luciferase activity.

In an aspect, the disclosure relates to an isolated polynucleotide encoding an OgLuc variant polypeptide having at least 80% amino acid sequence identity to an OgLuc polypeptide of SEQ ID NO: 1 comprising amino acid substitutions A4E, Q11R, A33K, V44I, P115E, Q124K, Y138I, N166R, Q18L, F54I, L92H, and Y109F corresponding to SEQ ID NO: 1 and the OgLuc variant polypeptide having luciferase activity.

In an aspect, the disclosure relates to an isolated polynucleotide encoding an OgLuc variant polypeptide having at least 80% amino acid sequence identity to an OgLuc polypeptide of SEQ ID NO: 1 comprising amino acid substitutions A4E, Q11R, A33K, V44I, A54I, F77Y, I90V, P115E, Q124K, Y138I and N166R corresponding to SEQ ID NO: 1 and the OgLuc variant polypeptide having luciferase activity.

In an aspect, the disclosure relates to an isolated polynucleotide encoding an OgLuc variant polypeptide having at least 80% amino acid sequence identity to an OgLuc polypeptide of SEQ ID NO: 1, wherein the amino acid at position 4 is glutamate, at position 11 is arginine, at position 18 is leucine, at position 33 is lysine, at position 44 is isoleucine, at position 54 is isoleucine, at position 92 is histidine, at position 109 is phenylalanine, at position 115 is glutamate, at position 124 is lysine, at position 138 is isoleucine, and at position 166 is arginine corresponding to SEQ ID NO: 1 and the OgLuc variant polypeptide having luciferase activity.

In an aspect, the disclosure relates to an isolated polynucleotide encoding an OgLuc variant polypeptide having at least 80% amino acid sequence identity to an OgLuc polypeptide of SEQ ID NO: 1, wherein the amino acid at position 4 is glutamate, at position 11 is arginine, at position 33 is lysine, at position 44 is isoleucine, at position 54 is isoleucine, at position 77 is tyrosine, at position 90 is valine, at position 115 is glutamate, at position 124 is lysine, at position 138 is isoleucine, and at position 166 is arginine corresponding to SEQ ID NO: 1 and the OgLuc variant polypeptide having luciferase activity.

In an aspect, the disclosure relates to an isolated polynucleotide comprising the polynucleotide encoding the polypeptide of SEQ ID NO: 19.

In an aspect, the disclosure relates to an isolated polynucleotide comprising the polynucleotide of SEQ ID NO: 18, SEQ ID NO: 24, SEQ ID NO: 25, SEQ ID NO: 42, SEQ ID NO: 88, or SEQ ID NO: 92.

In an aspect, the disclosure relates to an isolated polynucleotide encoding a decapod luciferase polypeptide having at least 30% amino acid sequence identity to SEQ ID NO: 1, the polypeptide comprising a sequence pattern corresponding to the sequence pattern of Formula (VII) and including no more than 5 differences, wherein differences include differences from pattern positions 1, 2, 3, 5, 8, 10, 12, 14, 15, 17, or 18 relative to Formula (VII) according to the OgLuc pattern listed in Table 4 as well as gaps or insertions between any of the pattern positions of Formula (VII) according to the OgLuc pattern listed in Table 4, wherein the decapod luciferase produces luminescence in the presence of a coelenterazine.

In an aspect, the disclosure relates to a synthetic nucleotide sequence encoding an OgLuc variant polypeptide comprising a fragment of at least 100 nucleotides having 80% or less nucleic acid sequence identity to a parent nucleic acid sequence having SEQ ID NO: 2 and having 90% or more nucleic acid sequence identity to SEQ ID NO: 22, SEQ ID NO: 23, SEQ ID NO: 24, or SEQ ID NO: 25 or the complement thereof, wherein the decreased sequence identity is a result of different codons in the synthetic nucleotide sequence relative to the codons in the parent nucleic acid sequence, wherein the synthetic nucleotide sequence encodes a OgLuc variant which has at least 85% amino acid sequence identity to the corresponding luciferase encoded by the parent nucleic acid sequence, and wherein the synthetic nucleotide sequence has a reduced number of regulatory sequences relative to the parent nucleic acid sequence.

In an aspect, the disclosure relates to a synthetic nucleotide sequence encoding an OgLuc variant polypeptide comprising a fragment of at least 300 nucleotides having 80% or less nucleic acid sequence identity to a parent nucleic acid sequence having SEQ ID NO: 14 and having 90% or more nucleic acid sequence identity to SEQ ID NO: 22 or SEQ ID NO: 23 or the complement thereof, wherein the decreased sequence identity is a result of different codons in the synthetic nucleotide sequence relative to the codons in the parent nucleic acid sequence, wherein the synthetic nucleotide sequence encodes a firefly luciferase which has at least 85% amino acid sequence identity to the corresponding luciferase encoded by the parent nucleic acid sequence, and wherein the synthetic nucleotide sequence has a reduced number of regulatory sequences relative to the parent nucleic acid sequence.

In an aspect, the disclosure relates to a synthetic nucleotide sequence encoding an OgLuc variant polypeptide comprising a fragment of at least 100 nucleotides having 80% or less nucleic acid sequence identity to a parent nucleic acid sequence having SEQ ID NO: 18 and having 90% or more nucleic acid sequence identity to SEQ ID NO: 24 or SEQ ID NO: 25 or the complement thereof, wherein the decreased sequence identity is a result of different codons in the synthetic nucleotide sequence relative to the codons in the parent nucleic acid sequence, wherein the synthetic nucleotide sequence encodes a OgLuc variant which has at least 85% amino acid sequence identity to the corresponding luciferase encoded by the parent nucleic acid sequence, and wherein the synthetic nucleotide sequence has a reduced number of regulatory sequences relative to the parent nucleic acid sequence.

In an aspect, the disclosure relates to a fusion peptide comprising a signal peptide from *Oplophorus gracilirostris* fused to a heterologous protein, wherein said signal peptide is SEQ ID NO: 54, wherein the fusion peptide is expressed in a cell and secreted from the cell.

In an aspect, the disclosure relates to a method of generating a polynucleotide encoding a OgLuc variant polypeptide comprising: (a) using a parental fusion protein construct comprising a parental OgLuc polypeptide and at least one heterologous polypeptide to generate a library of variant fusion proteins; and (b) screening the library for at least one of enhanced luminescence, enhanced enzyme stability or enhanced biocompatibility relative to the parental fusion protein construct.

In an aspect, the disclosure relates to a method of generating codon-optimized polynucleotides encoding a luciferase for use in an organism, comprising: for each amino acid in the luciferase, randomly selecting a codon from the two most commonly used codons used in the organism to encode for the amino acid to produce a first codon-optimized polynucleotide.

Other aspects of the invention will become apparent by consideration of the detailed description and accompanying drawings.

BRIEF DESCRIPTION OF THE DRAWINGS

FIGS. 5A, 5C-5G show independent experiments measuring the luminescence in RLUs generated by C1+A4E with known and novel coelenterazines using native coelenterazine as a comparison. FIG. 5B shows the fold-decrease in luminescence generated by C1+4AE using the substrates shown in FIG. 5A compared to native coelenterazine.

FIGS. 6A-D show the luminescence generated from lysed bacterial cells expressing various OgLuc variants using native coelenterazine ("Coelente"), known coelenterazine-h ("h"), known coelenterazine-hh ("h,h"), known 2-methyl coelenterazine ("2-me"), known coelenterazine-v ("v"), and novel coelenterazines PBI-3840, PBI-3897, PBI-3889, PBI-3899, PBI-3900, PBI-3912, PBI-3913, PBI-3925, PBI-3897, PBI-3899, PBI-3889, PBI-3939, PBI-3933, PBI-3932, PBI-3946, PBI-3897, PBI-3841, PBI-3896, PBI-3925, and PBI-3945 as substrates.

FIG. 7 shows the amino acid substitutions in various OgLuc variants.

FIGS. 8A-B show the luminescence generated from lysed bacterial cells expressing OgLuc variants listed in FIG. 7 using native coelenterazine ("Coelenterazine"), known coelenterazine-h ("H"), known coelenterazine-hh ("h,h"), and novel coelenterazines PBI-3840, PBI-3925, PBI-3912, PBI-3889, PBI-3939, PBI-3933, PBI-3932, PBI-3946, PBI-3941, and PBI-3896 as substrates.

FIG. 9 shows the luminescence generated from lysed bacterial cells expressing various OgLuc variants using native coelenterazine ("Coelenterazine"), known coelenterazine-hh ("h,h"), and novel coelenterazines PBI-3939, PBI-3945, PBI-3840, PBI-3932, PBI-3925, PBI-9894, and PBI-3896 as substrates.

FIG. 10 shows the amino acid substitutions in various OgLuc variants.

FIG. 11 shows the luminescence generated from lysed bacterial cells expressing OgLuc variants listed in FIG. 10 using native coelenterazine ("Coelenterazine"), known coelenterazine-hh ("h,h"), and novel coelenterazines PBI-3939, PBI-3945, PBI-3840, PBI-3932, PBI-3925, PBI-3894, and PBI-3896, as substrates.

FIG. 12 shows the luminescence generated from lysed bacterial cells expressing OgLuc variants using native coelenterazine ("Coelenterazine"), known coelenterazine-hh ("h,h"), and novel coelenterazines PBI-3939, PBI-3945, PBI-3889, PBI-3840, PBI-3932, PBI-3925, PBI-3894, PBI-3896, and PBI-3897 as substrates.

FIG. 13 shows the luminescence generated from lysed bacterial cells expressing OgLuc variants using native coelenterazine ("Coelenterazine"), known coelenterazine-hh ("H,H"), and novel coelenterazines PBI-3897, PBI-3896, and PBI-3894 as substrates.

FIG. 14 shows the amino acid substitutions in various OgLuc variants.

FIG. 15 shows the luminescence generated from lysed bacterial cells expressing OgLuc variants listed in FIG. 14 using native coelenterazine ("Coelenterazine"), known coelenterazine-hh ("h,h"), and novel coelenterazines PBI-3897, PBI-3841, PBI-3896, and PBI-3894 as substrates.

FIG. 16 shows the luminescence generated from lysed bacterial cells expressing OgLuc variants using native coelenterazine ("Coelenterazine"), known coelenterazine-h ("H"), known coelenterazine-hh ("HH"), and novel coelenterazines PBI-3841 and PBI-3897 as substrates.

FIG. 18 shows the luminescence generated from lysed bacterial cells expressing various OgLuc variants using native coelenterazine ("Coelenterazine"), known coelenterazine-hh ("h,h"), and novel coelenterazines PBI-3939, PBI-3945, PBI-3889, and PBI-4002 as substrates.

FIG. 19 shows the luminescence generated from lysed bacterial cells expressing various OgLuc variants using native coelenterazine ("Coelenterazine"), known coelenterazine-h ("H"), known coelenterazine-hh ("h,h"), and novel coelenterazines PBI-3939, PBI-3945, PBI-3889, and PBI-4002 as substrates.

FIG. 20 shows the amino acid substitutions in various OgLuc variants.

FIG. 21 shows the luminescence generated from lysed bacterial cells expressing OgLuc variants listed in FIG. 20 using native coelenterazine ("Coelenterazine"), known coelenterazine-h ("H"), known coelenterazine-hh ("h,h"), and novel coelenterazines PBI-3939, PBI-3945, PBI-4002, PBI-3932, and PBI-3840 as substrates.

FIG. 22 shows the amino acid substitutions in various OgLuc variants.

FIG. 23 shows the luminescence generated from lysed bacterial cells expressing OgLuc variants listed in FIG. 22 using native coelenterazine ("Coelenterazine"), known coelenterazine-h ("H"), known coelenterazine-hh ("h,h"), and novel coelenterazines PBI-3939, PBI-3945, PBI-3889, PBI-4002, PBI-3932, and PBI-3840 as substrates.

FIG. 26 shows the amino acid substitutions in various OgLuc variants.

FIG. 27 shows the luminescence generated from lysed bacterial cells expressing OgLuc variants listed in FIG. 26 using native coelenterazine ("Coelenterazine"), known coelenterazine-h ("H"), known coelenterazine-hh ("h,h"), and novel coelenterazines PBI-3939, PBI-3945, PBI-3889, and PBI-4002 as substrates.

FIGS. 30A-D show mutational analysis at position 166 using native coelenterazine (FIG. 30A), coelenterazine-h (FIG. 30B), and PBI-399 (FIG. 30C).

(FIG. 39A) and 37° C. (FIG. 39B) compared to Renilla (hRL) and firefly luciferase (Luc2).

FIGS. 73A-D show the basal luminescence of the various CP-TEV protease L27V constructs prior to TEV addition. FIG. 73E shows the response of the CP-TEV protease L27V constructs of FIGS. 73A-D.

FIGS. 82A-C show the use of the OgLuc variant 9B8 opt to monitor intracellular signaling pathways using PBI-4377 (FIG. 82A). The 9B8 opt luciferase was fused to either IkB (FIG. 82B) or ODD (oxygen-dependent degradation domain of Hif-1α) (FIG. 82C), and fold response to a stimulus (TNFα for IkB and phenanthroline for ODD) was monitored via luminescence.

FIGS. 90A-B show the bioluminescence imaging of hormone-induced nuclear receptor (NR) translocation of OgLuc fusions using PBI-3939 substrate.

FIGS. 91A-B show the bioluminescence imaging of phorbol ester-induced Protein Kinase C alpha (PKC alpha) translocation of OgLuc fusions using PBI-3939 substrate.

DETAILED DESCRIPTION

Figure 1:
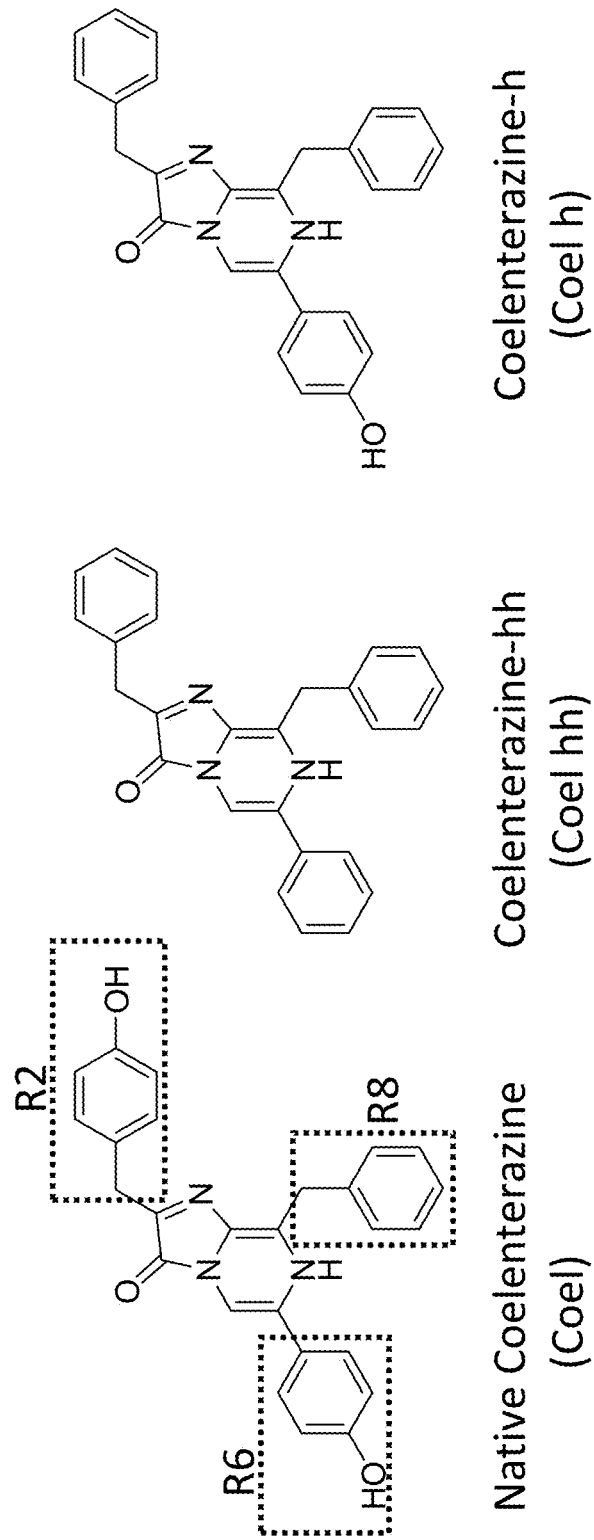
FIG. 1 shows the chemical structure of native coelenterazine, known bis-coelenterazine (coelenterazine-hh), and known coelenterazine-h, where R2, R6 and R8 represent the regions of the molecule where modifications were made.

Before any embodiments of the invention are explained in detail, it is to be understood that the invention is not limited in its application to the details of structure, synthesis, and arrangement of components set forth in the following description or illustrated in the following drawings. The invention is described with respect to specific embodiments and techniques, however, the invention is capable of other embodiments and of being practiced or of being carried out in various ways.

In the following description of the methods of the invention, process steps are carried out at room temperature (about 22° C.) and atmospheric pressure unless otherwise specified. It also is specifically understood that any numerical range recited herein includes all values from the lower value to the upper value. For example, if a concentration range or beneficial effect range is stated as 1% to 50%, it is intended that values such as 2% to 40%, 10% to 30%, or 1% to 3%, etc. are expressly enumerated in this specification. Similarly, if a sequence identity range is given as between, e.g., 60% to <100%, it is intended that intermediate values such as 65%, 75%, 85%, 90%, 95%, etc. are expressly enumerated in this specification. These are only examples of what is specifically intended, and all possible numerical values from the lowest value to the highest value are considered expressly stated in the application.

Unless expressly specified otherwise, the term "comprising" is used in the context of the present application to indicate that further members may optionally be present in addition to the members of the list introduced by "comprising". It is, however, contemplated as a specific embodiment of the present invention that the term "comprising" encompasses the possibility of no further members being present, i.e., for the purpose of this embodiment "comprising" is to be understood as having the meaning of "consisting of".

The following detailed description discloses specific and/or preferred variants of the individual features of the invention. The present invention also contemplates, as particularly preferred embodiments, those embodiments which are generated by combining two or more of the specific and/or preferred variants described for two or more of the features of the present invention.

Unless expressly specified otherwise, all indications of relative amounts in the present application are made on a weight/weight basis. Indications of relative amounts of a component characterized by a generic term are meant to refer to the total amount of all specific variants or members covered by said generic term. If a certain component defined by a generic term is specified to be present in a certain relative amount, and if this component is further characterized to be a specific variant or member covered by the generic term, it is meant that no other variants or members covered by the generic term are additionally present such that the total relative amount of components covered by the generic term exceeds the specified relative amount. More preferably, no other variants or members covered by the generic term are present at all.

Overview

In various aspects, the invention is drawn to novel compounds, novel luciferases, and combinations thereof. The invention encompasses methods, compositions, and kits including the novel compounds, novel luciferases, and/or combinations thereof.

The novel compounds are novel coelenterazines, which can be used as substrates by proteins that utilize coelenterazines to produce luminescence, including, but not limited to, luciferases and photoproteins found in various marine organisms such as cnidarians (e.g., *Renilla* luciferase), jellyfish (e.g., aequorin from the *Aequorea* jellyfish) and decapods luciferases (e.g., luciferase complex of *Oplophorus gracilirostris*). In various embodiments, the novel coelenterazines of the present invention have at least one of enhanced physical stability (e.g., enhanced coelenterazine stability), reduced autoluminescence, and increased biocompatibility with cells (e.g., less toxic to cells, including heterologous cell types) relative to native coelenterazine.

The novel luciferases disclosed herein include variants of the active subunit of a decapod luciferase. The novel luciferases can utilize various coelenterazines as substrates, including, but not limited to, native and known coelenterazines as well as the novel coelenterazines of the present invention. The novel luciferases display at least one of: enhanced luminescence (including increased brightness, enhanced signal stability and/or signal duration); enhanced enzyme stability (i.e., enhanced enzymatic activity including enhanced resistance to elevated temperature, changes in pH, inhibitors, denaturants, and/or detergents); altered substrate specificity (i.e., change in relative substrate specificity); and enhanced biocompatibility (including at least one of improved expression in cells, reduced toxicity, and/or cell stress). In various embodiments, the present invention encompasses novel luciferases that are present in solution as soluble, active monomers, chemically linked to other molecules (e.g., fusion proteins), or attached onto a solid surface (e.g., particles, capillaries, or assay tubes or plates).

Certain combinations of the novel coelenterazines and the novel luciferases provide significant technical advantages for bioluminescent assays including enhanced luminescence, wherein enhanced luminescence may be due to one or more factors including enhanced signal stability and enhanced coelenterazine stability. Additionally, many of the novel coelenterazines were designed to be smaller than commercially-available and/or known coelenterazines. In some cases, the novel luciferases of the present invention preferentially utilize the novel, smaller coelenterazines over the commercially-available and/or known larger coelenterazines.

The invention encompasses combinations of: the novel luciferase variants with the novel coelenterazines; the novel luciferase variants with known or native coelenterazines; and the novel coelenterazines with any known or native protein (e.g., luciferases or photoproteins) that uses coelenterazine as a substrate.

The term "coelenterazine" refers to naturally-occurring ("native") coelenterazine as well as analogs thereof, including coelenterazine-n, coelenterazine-f, coelenterazine-h, coelenterazine-hcp, coelenterazine-cp, coelenterazine-c, coelenterazine-e, coelenterazine-fcp, bisdeoxycoelenterazine ("coelenterazine-hh"), coelenterazine-i, coelenterazine-icp, coelenterazine-v, and 2-methyl coelenterazine, in addition to those disclosed in WO 2003/040100 and U.S. application Ser. No. 12/056,073 (paragraph [0086]), the disclosures of which are incorporated by reference herein. The term "coelenterazine" also refers to the novel coelenterazines disclosed herein (see below). The term "known coelenterazine" refers to a coelenterazine analog known prior to the present invention.

The term "OgLuc" refers to a decapod luciferase protein, or a variant of such a protein, which generates light in the presence of a coelenterazine. The OgLuc protein may, in its naturally-occurring form, be a monomer or may be a subunit of a protein complex. The OgLuc used in the exemplary embodiments disclosed herein is the 19 kDa subunit from the luciferase complex of *Oplophorus gracilirostris*, although comparable polypeptides from other decapod species (including other *Oplophorus* species) could also be employed and are encompassed within the invention (see R. D. Dennell, Observations on the luminescence of bathypelagic Crustacea decapoda of the Bermuda area, *Zool. J. Linn. Soc., Lond.* 42 (1955), pp. 393-406; see also Poupin et al. September 1999. Inventaire documenté des espècies et bilan des formes les plus communes de la mer d'Iroise. *Rapport Scientifique du Laboratoire d'Océanographie de l'École Navale (LOEN)*, Brest (83 pgs), each of which is incorporated by reference herein); examples include, without limitation, luciferases of the Aristeidae family, including *Plesiopenaeus coruscans*; the Pandalidea family, including *Heterocarpus* and *Parapandalus richardi*, the Solenoceridae family, including *Hymenopenaeus debilis* and *Mesopenaeus tropicalis*; the Luciferidae family, including *Lucifer typus*; the Sergestidae family, including *Sergestes atlanticus, Sergestes arcticus, Sergestes armatus, Sergestes pediformis, Sergestes cornutus, Sergestes edwardsi, Sergestes henseni, Sergestes pectinatus, Sergestes sargassi, Sergestes similis, Sergestes vigilax, Sergia challengeri, Sergia grandis, Sergia lucens, Sergia prehensilis, Sergia potens, Sergia robusta, Sergia scintillans*, and *Sergia splendens*; the Pasiphaeidae family, including *Glyphus marsupialis, Leptochela bermudensis, Parapasiphae sulcatifrons*, and *Pasiphea tarda*; the Oplophoridae family, including *Acanthephyra acanthitelsonis, Acanthephyra acutifrons, Acanthephyra brevirostris, Acanthephyra cucullata, Acanthephyra curtirostris, Acanthephyra eximia, Acanthephyra gracilipes, Acanthephyra kingsleyi, Acanthephyra media, Acanthephyra microphthalma, Acanthephyra pelagica, Acanthephyra prionota, Acanthephyra purpurea, Acanthephyra sanguinea, Acanthephyra sibogae, Acanthephyra stylorostratis, Ephyrina bifida, Ephyrina figueirai, Ephyrina koskynii, Ephyrina ombango, Hymenodora glacialis, Hymenodora gracilis, Meningodora miccyla, Meningodora mollis, Meningodora vesca, Notostomus gibbosus, Notostomus auriculatus, Oplophorus gracilirostris, Oplophorus grimaldii, Oplophorus novaezealandiae, Oplophorus spinicauda, Oplophorus foliaceus, Oplophorus spinosus, Oplophorus typus, Systellaspis braueri, Systellaspis cristata, Systellaspis debilis*, and *Systellaspis pellucida*; and the Thalassocaridae family, including *Chlorotocoides spinicauda, Thalassocaris crinita*, and *Thalassocaris lucida*.

The polypeptide sequence of the mature (i.e., with no signal sequence) 19 kDa subunit of the naturally-occurring form of the *Oplophorus gracilirostris* luciferase (i.e., 169 amino acids, residues 28 to 196 of BAB 13776) is given in SEQ ID NO: 1. In various embodiments, a methionine residue and a valine residue are inserted at the beginning of the synthetic OgLuc sequence (e.g., as indicated in the C1+A4E polypeptide sequence, SEQ ID NO: 3) to facilitate cloning and expression in heterologous systems. Nevertheless, for consistency, the position numbers of the various amino acid substitutions referred to herein are specified "relative to" SEQ ID NO: 1, i.e., the polypeptide sequence of the mature (with no signal sequence), native 19 kDa subunit of the *Oplophorus gracilirostris* luciferase protein complex.

Specifically, a protein is a decapod luciferase if, upon alignment of its amino acid sequence with SEQ ID NO: 1, the sequence identity is >30%, preferably >40%, and most preferably >50%, and the protein can utilize coelenterazine as a substrate to catalyze the emission of luminescence, and the amino acid sequence beginning at the position corresponding to position 8 of SEQ ID NO: 1 is:

```
(VII)
                                      (SEQ ID NO. 330)
[GSAIVK]-{FE}-[FYW]-x-[LIVMFSYQ]-x-x-{K}-x-[NHGK]- x-[DE]-x-[LIVMFY]-[LIVMWF]-x-{G}-[LIVMAKRG],
``` with no more than 5 differences, or more preferably no more than 4, 3, 2, or 1 difference, or most preferably no differences, wherein the differences occur in positions corresponding to pattern position 1, 2, 3, 5, 8, 10, 12, 14, 15, 17, or 18 of Formula (VII) according to Table 4. Differences may also include gaps or insertions between the pattern positions of Table 4.

The term "variant" refers to a modified version of a starting polypeptide or polynucleotide sequence. The term "parental" is a relative term that refers to a starting sequence which is then modified. The parental sequence is generally used as a reference for the protein encoded by the resulting modified sequence, e.g., to compare the activity levels or other properties of the proteins encoded by the parental and the modified sequences. The starting sequence can be a naturally-occurring (i.e., native or wild-type) sequence. The starting sequence can also be a variant sequence which is then further modified. A polypeptide sequence is "modified" when one or more amino acids (which may be naturally-occurring or synthetic) are substituted, deleted, and/or added at the beginning, middle, and/or end of the sequence. A polynucleotide sequence is "modified" when one or more nucleotides are substituted, deleted, and/or added at the beginning, middle, and/or end of the sequence, but which may or may not alter the amino acid encoded by the sequence. In some embodiments, the modifications produce a variant that is a functional fragment of a particular OgLuc or OgLuc variant. A functional fragment is a fragment which is less than a full-length parental sequence which has the same functional activity as the full-length parental sequence. Functional activity is the ability to exhibit luminescence. In some embodiments, the modifications produce a variant that is a permuted sequence of the parental sequence, such as a circularly permuted sequence and permuted sequences comprising deletions and/or insertions.

Several of the OgLuc variants disclosed herein have been assigned shorthand names to facilitate discussion. The term "C1+A4E" (also referred to as "C1A4E") refers to a particular OgLuc variant with the amino acid substitutions A4E, Q11R, A33K, V44I, A54F, P115E, Q124K, Y138I, and N166R relative to SEQ ID NO: 1 (SEQ ID NOs: 2 and 3) (where the format "x#y" indicates a parent amino acid 'x' at a position '#' that is changed to variant amino acid 'y'). Variants of the C1+A4E OgLuc variant which are presented herein contain at least the amino acid substitutions found in C1+A4E, unless otherwise indicated. The term "IVY" refers to a variant of the C1+A4E OgLuc variant having additional amino acid substitutions F54I, I90V, and F77Y relative to SEQ ID NO: 1 (SEQ ID NOs: 8 and 9). The term "IV" refers to another variant of the C1+A4E OgLuc variant having additional amino acid substitutions F54I and I90V relative to SEQ ID NO: 1 (SEQ ID NOs: 14 and 15). The term "QC27" refers to yet another variant of the C1+A4E OgLuc variant having additional amino acid substitutions Q18L, F54I, L92H, and Y109F relative to SEQ ID NO: 1 (SEQ ID NOs: 4 and 5). The term "QC27-9a" refers to a variant of the QC27 OgLuc variant with additional amino acid substitutions V21L, F68Y, L72Q, M75K, H92R, and V158F relative to SEQ ID NO: 1 (SEQ ID NOs: 6 and 7). The term "9B8" refers to a variant of the IV OgLuc variant with additional amino acid substitutions Q18L, F68Y, L72Q, and M75K relative to SEQ ID NO: 1 (SEQ ID NOs: 18 and 19). The term "9B8 opt" refers to the codon optimized version of the 9B8 variant (SEQ ID NO: 24). The term "9B8 opt+K33N" refers to a variant of the 9B8 opt variant with additional amino acid substitution K33N relative to SEQ ID NO: 1 (SEQ ID NOs: 42 and 43). The term "9B8 opt+K33N+ 170G" refers to a variant of the "9B8 opt+K33N" variant with an additional glycine appended to the C-terminus of the variant, i.e., 170G relative to SEQ ID NO: 1 (SEQ ID NO: 68 and 69). The terms "L27V+T39T+K43R+Y68D" and "L27V" refers to a variant of the 9B8 opt+K33N" variant with additional amino acid substitutions L27V, T39T, K43R, and Y68D relative to SEQ ID NO: 1 (SEQ ID NOs: 88 and 89). The terms "T39T+K43R+Y68D" and "V2" refers to a variant of the "9B8 opt+K33N" variant with additional amino acid substitutions T39T, K43R, and Y68D relative to SEQ ID NO: 1 (SEQ ID NOs: 92 and 93).

In general, "enhanced" means that the particular property (e.g., luminescence, signal stability, biocompatibility, protein stability (e.g., enzyme stability), or protein expression) is increased relative to that of the reference luciferase plus coelenterazine combination or luciferase under consideration, where the increase is at least 1%, at least 5%, at least 10%, at least 20%, at least 25%, at least 50%, at least 75%, at least 90%, at least 100%, at least 200%, at least 500%, or at least 1000% greater than the reference luciferase plus coelenterazine combination or luciferase under consideration.

The term "luminescence" refers to the light output of the OgLuc variant under appropriate conditions, e.g., in the presence of a suitable substrate such as a coelenterazine. The light output may be measured as an instantaneous or near-instantaneous measure of light output (which is sometimes referred to as "T=0" luminescence or "flash") at the start of the luminescence reaction, which may be initiated upon addition of the coelenterazine substrate. The luminescence reaction in various embodiments is carried out in a solution. In other embodiments, the luminescence reaction is carried out on a solid support. The solution may contain a lysate, for example from the cells in a prokaryotic or eukaryotic expression system. In other embodiments, expression occurs in a cell-free system, or the luciferase protein is secreted into an extracellular medium, such that, in the latter case, it is not necessary to produce a lysate. In some embodiments, the reaction is started by injecting appropriate materials, e.g., coelenterazine, buffer, etc., into a reaction chamber (e.g., a well of a multiwell plate such as a 96-well plate) containing the luminescent protein. In still other embodiments, the OgLuc variant and/or novel coelenterazine are introduced into a host and measurements of luminescence are made on the host or a portion thereof, which can include a whole organism or cells, tissues, explants, or extracts thereof. The reaction chamber may be situated in a reading device which can measure the light output, e.g., using a luminometer or photomultiplier. The light output or luminescence may also be measured over time, for example in the same reaction chamber for a period of seconds, minutes, hours, etc. The light output or luminescence may be reported as the average over time, the half-life of decay of signal, the sum of the signal over a period of time, or the peak output. Luminescence may be measured in Relative Light Units (RLUs).

The "enhanced luminescence" of an OgLuc variant may be due to one or more of the following characteristics: enhanced light output (i.e., brightness), enhanced substrate specificity, enhanced signal stability, and/or enhanced signal duration. Enhanced signal stability includes an increase in how long the signal from a luciferase continues to luminesce, for example, as measured by the half-life of decay of the signal in a time-course. Enhanced luminescence may be determined relative to the comparable property of a luciferase such as wild-type OgLuc, an OgLuc variant protein, *Renilla* luciferase (e.g., hRluc), or firefly luciferase (e.g., Luc2 luciferase from *Photinus pyralis*) combined with a native, known, or novel substrate, as shown in the Examples below. For example, the luminescence of a given OgLuc variant in combination with a particular coelenterazine (including native, known, or novel coelenterazines) may be compared to the properties of one of OgLuc variants C1+A4E, IV, or IVY combined with any of a native, known, or novel coelenterazine disclosed herein, using one or more of the assays disclosed in the Examples below. In particular, enhanced luminescence may be determined by measuring the luminescence signal (RLU) resulting from the incubation of bacterial lysates containing OgLuc variants in question with the substrate, PBI-3939. Measurements are taken in a reagent which may contain TERGITOL™ to provide Glo-like kinetics, e.g., in which enzyme inactivation is slowed and the luminescence signal is stabilized, which is described elsewhere in the application. In some embodiments, some luciferase variants, e.g., L27V, with certain compounds, e.g., PBI-3939, provide extended duration of the luminescent emission, or glow-like kinetics, in the absence of TERGITOL™. The luminescence signal may be compared to that of a reference point such as the C1+A4E variant with coelenterazine or coelenterazine-h or *Renilla* luciferase with native coelenterazine.

"Enzyme stability" refers to the stability of enzyme activity (i.e., tolerance of enzymatic activity to reaction conditions). Enhanced enzyme stability refers to enhanced stability of enzyme activity (i.e., enhanced tolerance to reaction conditions). Enhanced enzyme stability includes enhanced thermal stability (e.g., stability at elevated temperatures) and chemical stability (e.g., stability in the presence of inhibitors or denaturants such as detergents, including, e.g., TRITON™ X-100). Enzyme stability can be used as a measure of protein stability, particularly under conditions known to be disruptive of protein structure, such as high temperatures or the presence of chemical denaturants. In particular, enhanced protein stability may be determined using thermal analysis as described elsewhere in the application (e.g., in Example 28). The luminescence signal may be compared to the reference point of C1+A4E variant with coelenterazine or coelenterazine-h or *Renilla* luciferase with native coelenterazine.

"Biocompatibility" refers to the tolerance of a cell (e.g., prokaryotic or eukaryotic) to a luciferase and/or coelenterazine compound. Biocompatibility of a luciferase and/or coelenterazine compound is related to the stress it causes on the host cell. For example, a luciferase that is not tolerated by the cell (i.e., one that stresses a cell) may not be expressed efficiently within the cell, for example, the luciferase may be expressed within the cell, but exhibit reduced activity due to the formation of inclusion bodies by the expressed protein. Biocompatibility of a luciferase is related to the ability of the cells to tolerate the insertion of the foreign gene, i.e., a transgene containing the gene encoding the luciferase or fragment thereof, whereby the cells with the transgene do not exhibit manifestations of stress, including induction of stress response pathways, reduced rate of growth, and/or reduced viability (e.g., reduced number of living cells, reduced membrane integrity, or increased rates of apoptosis). Other indications of cell stress may include changes in gene expression, signaling pathways, and/or regulatory pathways. Enhanced biocompatibility of an OgLuc variant may be due to factors such as enhanced protein expression and/or reduced cell stress. Enhanced expression of luminescence for a particular polynucleotide encoding an OgLuc variant may be determined relative to luminescence expression levels for a polynucleotide encoding wild-type OgLuc or an OgLuc variant protein, including codon-optimized polynucleotides, where luminescence activity can be used as a means to monitor protein expression levels.

In particular, enhanced biocompatibility of the OgLuc variant, novel coelenterazine compound and/or a combination thereof, may be determined by measuring cell viability and/or growth rate of cells. For example, enhanced biocompatibility of the OgLuc variants may be determined by measuring cell viability and/or growth rate of cells containing the OgLuc variants compared to cells containing firefly or *Renilla* luciferase or no luciferase, in the absence of any coelenterazine compound to determine how compatible and/or toxic the luciferase is to the cells. Enhanced biocompatibility of the novel coelenterazine compounds may be determined by measuring cell viability in the absence of luciferase expression of cells exposed to the novel coelenterazine compound compared to native or known coelenterazines to determine how compatible and/or toxic the coelenterazine compound is to the cells. Enhanced biocompatibility of a combination of an OgLuc variant with a novel coelenterazine compound may be determined by measuring cell viability and/or growth rate of cells containing the OgLuc variant and exposed to the novel coelenterazine and compared to cells containing firefly or *Renilla* luciferase or no luciferase and exposed to native or known coelenterazines.

In particular, enhanced biocompatibility may be determined using cell viability analysis as described elsewhere in the application (e.g., using a CELLTITER-GLO® assay as described in Example 18 or an apoptosis assay such as one using CASPASE-GLO® technology according to the manufacturer's instructions) or one known in the art. The effect of an OgLuc variant on cell viability or apoptosis may be compared to the effect of a reference luciferase, such as the C1+A4E variant, a firefly luciferase or *Renilla* luciferase. The effect of the novel coelenterazine compound on cell viability or apoptosis may be compared to the effect of native or known coelenterazine compounds on cell viability or apoptosis.

Enhanced biocompatibility may also be determined by measuring the effect of the OgLuc variant and/or novel coelenterazine compound on cell growth or gene expression. For examples, enhanced biocompatibility of the OgLuc variant may be determined by measuring the cell number after a period of time or by determining the expression of stress response genes in a sample of cells that contain the OgLuc variant compared to cells that contain another luciferase or no luciferase. Enhanced biocompatibility of the novel coelenterazine compound may be determined by measuring the cell number after a period of time or by determining the expression of stress response genes in a sample of cells that are exposed to the novel coelenterazine compound compared to cells exposed to native or known coelenterazines or no coelenterazines. The effect of the OgLuc variant on cell growth or gene expression may be compared to a reference luciferase, such as C1+A4E variant, a firefly luciferase or *Renilla* luciferase. The effect of the novel coelenterazine on cell growth or gene expression may be compared to native or known coelenterazines.

The identification of robust, stable cell lines expressing an OgLuc variant of the present invention, either in the cytoplasm or as a secreted form, can be facilitated by the bright signal of the luciferase and the small size of the OgLuc gene. The relatively small gene sequence is expected to reduce the likelihood of genetic instability resulting from the integration of the foreign DNA into a cell's genome. As a result of the increased brightness of the OgLuc variants and/or the novel coelenterazines of the present invention, less protein expression, and thereby less DNA needed for transfection, may produce a given level of brightness compared to other known luciferases such as native OgLuc, firefly, or *Renilla* luciferase, which contributes to an enhanced biocompatibility for the OgLuc variants and/or novel coelenterazines. Enhanced biocompatibility of the OgLuc variants may be measured by the amount of DNA or reagents, e.g., transfection chemicals, needed in transient transfections to generate cells with the same level of luminescence as cells transfected with other luciferases, e.g., native OgLuc, firefly or *Renilla* luciferase. In some embodiments, the amount of OgLuc variant DNA or reagents needed for transfection is less than the amount needed for another luciferase, e.g., native OgLuc, firefly, or *Renilla* luciferase, to generate transfected cells with the same level of luminescence obtained with the other luciferase. Enhanced biocompatibility of the OgLuc variants may be measured by the recovery time of the cells after transfection. In some embodiments, the amount of time needed for recovery after transfection with the OgLuc variant is less than the time needed for another luciferase, e.g., native OgLuc, firefly or *Renilla* luciferase.

"Relative substrate specificity" is determined by dividing the luminescence of a luciferase in the presence of a test coelenterazine substrate by the luminescence of the luciferase in the presence of a reference coelenterazine substrate. For example, relative specificity may be determined by dividing the luminescence of a luciferase with a novel coelenterazine of the present invention by the luminescence of the luciferase with a different coelenterazine (e.g., native or known coelenterazine, see FIG. 1 for examples, or a different novel coelenterazine of the present invention). The test coelenterazine substrate and the reference coelenterazine substrate that are compared are considered a comparison substrate pair for determining relative substrate specificity.

A "change in relative substrate specificity" is determined by dividing the relative substrate specificity of a test luciferase using a comparison substrate pair by the relative substrate specificity of a reference luciferase using the same comparison substrate pair. For example, a change in relative specificity may be determined by dividing the relative substrate specificity of a test luciferase with a novel coelenterazine of the present invention compared to a different coelenterazine (e.g., native or known coelenterazine or a different novel coelenterazine of the present invention), by the relative substrate specificity of a reference luciferase with the same novel coelenterazine of the present invention compared to the same different coelenterazine used for the test luciferase.

In some embodiments, the luminescence with one novel coelenterazine is compared to the luminescence with a different novel coelenterazine. In some embodiments, the luminescence with one native or known coelenterazine is compared to the luminescence with another native or known coelenterazine. In still other embodiments, the luminescence with one native or known coelenterazine is compared to the luminescence with a novel coelenterazine.

The novel coelenterazines of the present invention include properties such as enhanced physical stability (e.g., enhanced coelenterazine stability) or reduced autoluminescence. The physical stability of the coelenterazine refers to how stable the coelenterazine is in certain conditions such that it maintains the ability to luminesce when used as a substrate by a luciferase. Luminescence that is not dependent on the activity of a luciferase or photoprotein is termed autoluminescence. Autoluminescence is the luminescence of a substance produced by energy released in the form of light during decay or decomposition. For example, autoluminescence can be caused by spontaneous oxidation of the luminogenic substrate coelenterazine.

As used herein, "pure" or "purified" means an object species is the predominant species present (i.e., on a molar and/or mass basis, it is more abundant than any other individual species, apart from water, solvents, buffers, or other common components of an aqueous system in the composition), and, in some embodiments, a purified fraction is a composition wherein the object species comprises at least about 50% (on a molar basis) of all macromolecular species present. Generally, a "substantially pure" composition will comprise more than about 80% of all macromolecular species present in the composition, in some embodiments more than about 85%, more than about 90%, more than about 95%, or more than about 99%. In some embodiments, the object species is purified to essential homogeneity (contaminant species cannot be detected in the composition by conventional detection methods) wherein the composition consists essentially of a single macromolecular species.

Coelenterazine Derivatives

In some embodiments, the present invention provides novel coelenterazine derivatives of formula (Ia) or (Ib):

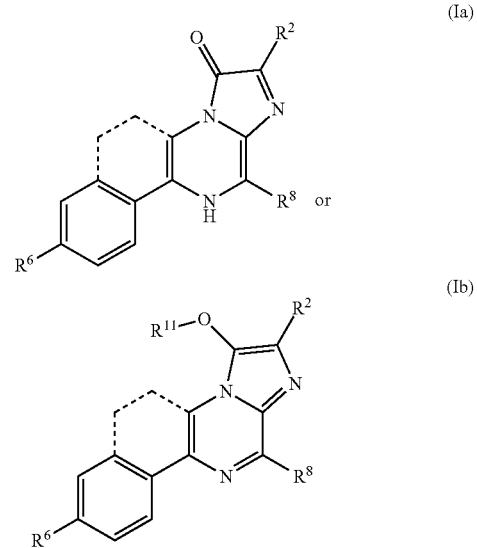

wherein $R^2$ is selected from the group consisting of

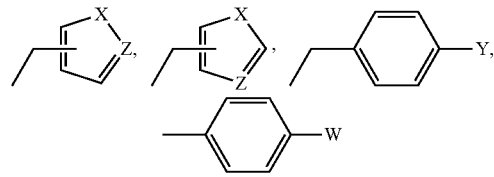

or $C_{2-5}$ straight chain alkyl;
$R^6$ is selected from the group consisting of —H, —OH, —NH$_2$, —OC(O)R or —OCH$_2$OC(O)R;
$R^8$ is selected from the group consisting of

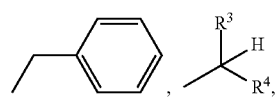

H or lower cycloalkyl;
wherein $R^3$ and $R^4$ are both H or both $C_{1-2}$ alkyl;
W is —NH$_2$, halo, —OH, —NHC(O)R, —CO$_2$R;
X is —S—, —O— or —NR$^{22}$—;
Y is —H, —OH, or —OR$^{11}$;
Z is —CH— or —N—;
each $R^{11}$ is independently —C(O)R" or —CH$_2$OC(O)R";
$R^{22}$ is H, CH$_3$, or CH$_2$CH$_3$;
each R is independently $C_{1-7}$ straight-chain alkyl or $C_{1-7}$ branched alkyl;
R" is $C_{1-7}$ straight-chain alkyl or $C_{1-7}$ branched alkyl;
the dashed bonds indicate the presence of an optional ring, which may be saturated or unsaturated;
with the proviso that when $R^2$ is

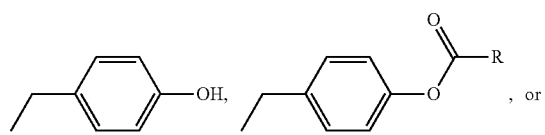

-continued

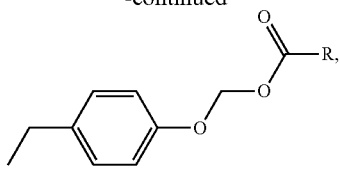

R⁸ is not

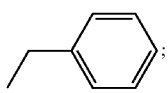

with the proviso that when R² is

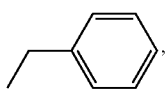

R⁸ is

or lower cycloalkyl; and
with the proviso that when R⁶ is NH₂, R² is

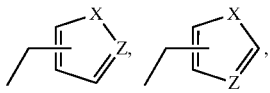

or C₂₋₅ alkyl;
or R⁸ is not

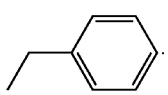

The term "alkyl", as used herein, pertains to a monovalent moiety obtained by removing a hydrogen atom from a hydrocarbon compound, and which may be saturated, partially unsaturated, or fully unsaturated. The alkyl group may be a straight-chain or branched. An alkyl group may be optionally substituted with, for example, halo. Examples of straight-chain alkyl groups include, but are not limited to, ethyl, n-propyl, n-butyl, and n-propyl, n-hexyl and n-heptyl. Examples of unsaturated alkyl groups which have one or more carbon-carbon double bonds include, but are not limited to, ethenyl (vinyl, —CH═CH₂), 2-propenyl (allyl, —CH—CH═CH₂), and butenyl. Examples of unsaturated alkyl which have one or more carbon-carbon triple bonds include, but are not limited to, ethynyl and 2-propynyl (propargyl). Examples of branched alkyl groups included isopropyl, iso-butyl, sec-butyl, t-butyl and iso-pentyl.

The term "lower cycloalkyl", as used herein, pertains to a monovalent moiety obtained by removing a hydrogen atom from a hydrocarbon compound having from 3 to 5 carbon atoms. Examples of saturated lower cycloalkyl groups include, but are not limited to, groups such as cyclopropyl, cyclobutyl and cyclopentyl. Examples of unsaturated lower cycloalkyl groups which have one or more carbon-carbon double bonds include, but are not limited to, groups such as cyclopropenyl, cyclobutenyl and cyclopentenyl.

The term "halo", as used herein, pertains to a halogen, such as Cl, F, Br or I.

In some embodiments, R² is

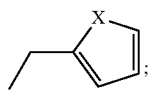

and X is O or S. In other embodiments, R² is C₂₋₅ straight chain alkyl. In certain embodiments, R⁸ is

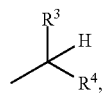

lower cycloalkyl or H. In other embodiments, R⁸ is benzyl. In some embodiments, R" is —C(CH₃)₃, —CH(CH₃)₂, —CH₂C(CH₃)₃, or —CH₂CH(CH₃)₂.

In some embodiments, the present invention provides compounds according to Formula (IIa) or (IIb):

(IIa)

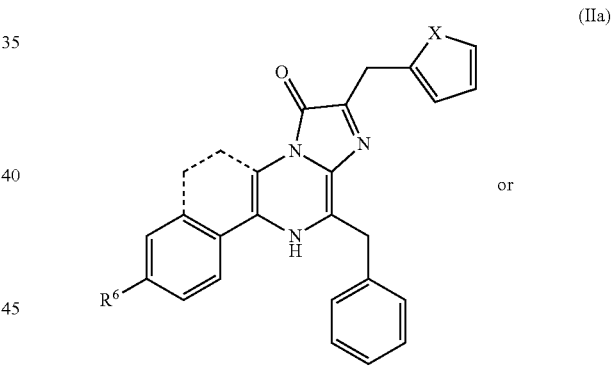

or (IIb)

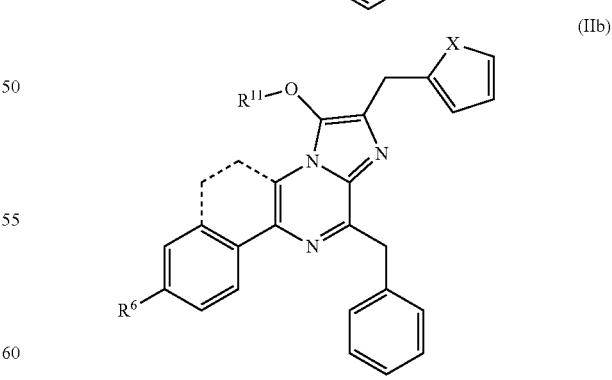

wherein X is O or S, R⁶ is H or OH, R¹¹ is as defined above, and the dashed bonds indicate the presence of an optional ring.

In some embodiments, the invention provides compounds according to Formula (IIIa) or (IIIb):

(IIIa)

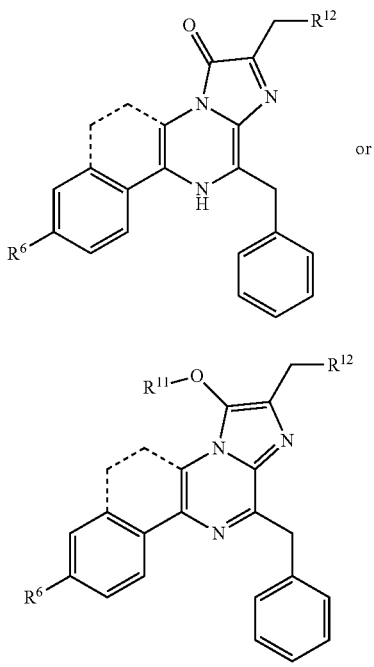

or (IIIb)

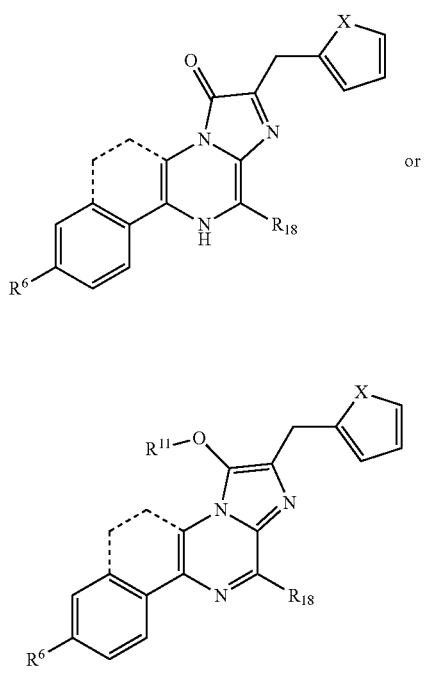

wherein $R^{12}$ is $C_{2-5}$ straight-chain alkyl, furyl or thienyl, $R^6$ is H or OH, $R^{11}$ is as defined above, and the dashed bonds indicate the presence of an optional ring.

In some embodiments, the invention provides compounds according to Formula (IVa) or (IVb):

(IVa)

(IVb)

wherein X is O or S, $R^6$ is H or OH, $R^{18}$ is H,

or lower cycloalkyl, $R^3$, $R^4$ and $R^{11}$ are as defined above, and the dashed bonds indicate the presence of an optional ring.

In some embodiments, the invention provides a compound according to Formula (Va) or (Vb):

(Va)

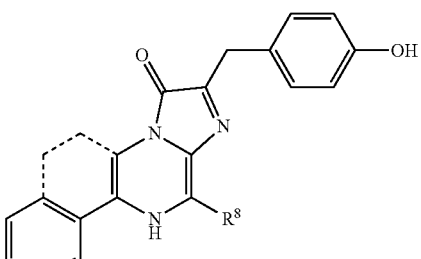

or (Vb)

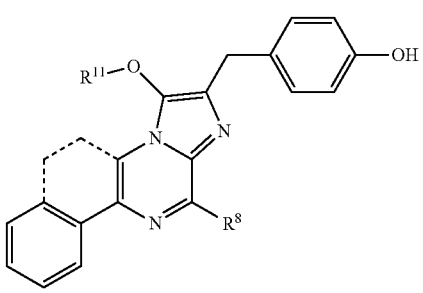

wherein $R^8$ is benzyl, $R^{11}$ is as defined above, and the dashed bonds indicate the presence of an optional ring.

In some embodiments, the present invention provides novel coelenterazine derivatives of formula (VIa) or (VIb):

(VIa)

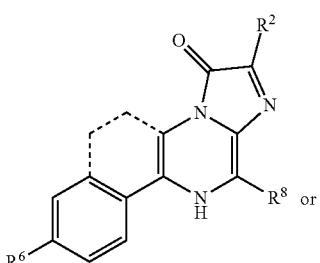

or (VIb)

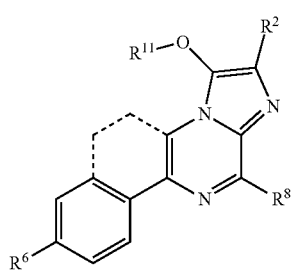

wherein $R^2$ is selected from the group consisting of

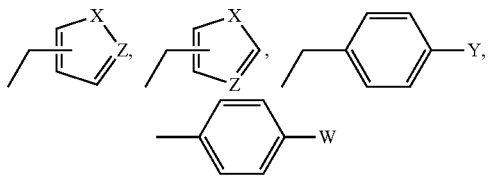

or $C_{2-5}$
straight chain alkyl;
$R^6$ is selected from the group consisting of —H, —OH, —NH$_2$, —OC(O)R or —OCH$_2$OC(O)R;
$R^8$ is selected from the group consisting of

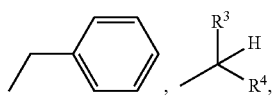

H or lower cycloalkyl;
wherein $R^3$ and $R^4$ are both H or both $C_{1-2}$ alkyl;
W is —NH$_2$, halo, —OH, —NHC(O)R, —CO$_2$R;
X is —S—, —O— or —NH—;
Y is —H, —OH, or —OR$^{11}$;
Z is —CH— or —N—;
each $R^{11}$ is independently —C(O)R" or —CH$_2$OC(O)R";
each R is independently $C_{1-7}$ straight-chain alkyl or $C_{1-7}$ branched alkyl;
R" is $C_{1-7}$ straight-chain alkyl or $C_{1-7}$ branched alkyl;
the dashed bonds indicate the presence of an optional ring, which may be saturated or unsaturated;
with the proviso that when $R^2$ is

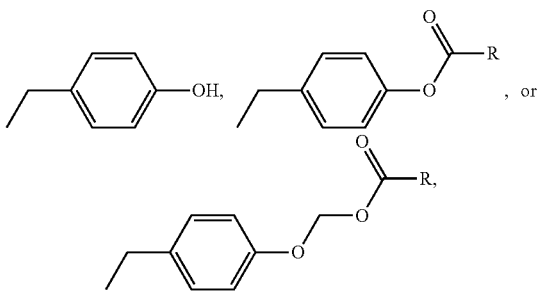

$R^8$ is not

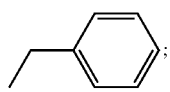

with the proviso that when $R^2$ is

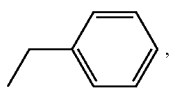

$R^8$ is

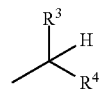

or lower cycloalkyl; and
with the proviso that when $R^6$ is NH$_2$, $R^2$ is

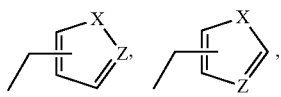

or $C_{2-5}$ alkyl;
or $R^8$ is not

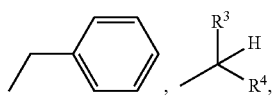

.

Suitable compounds according to the present invention include

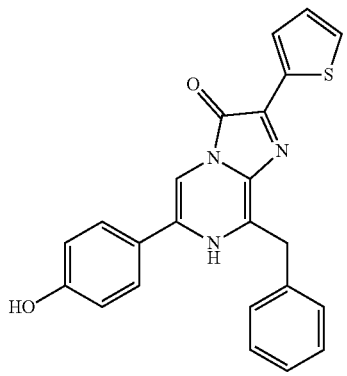

3882

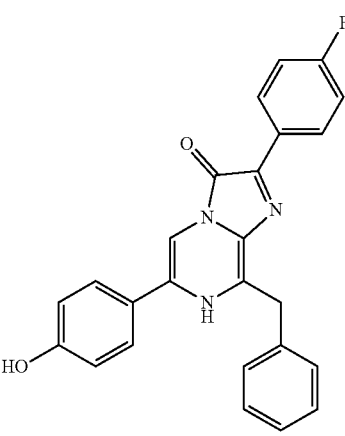

3881

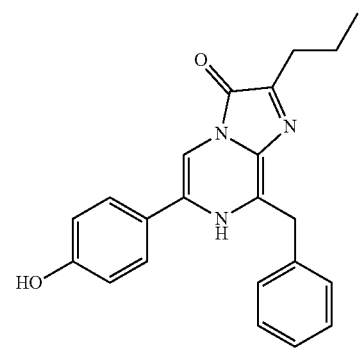
3899
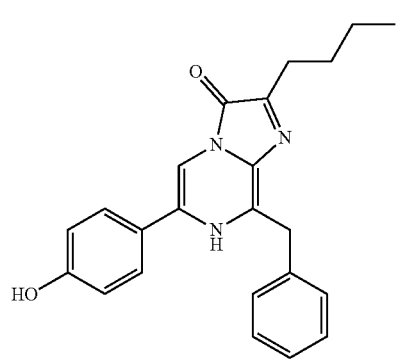
3900
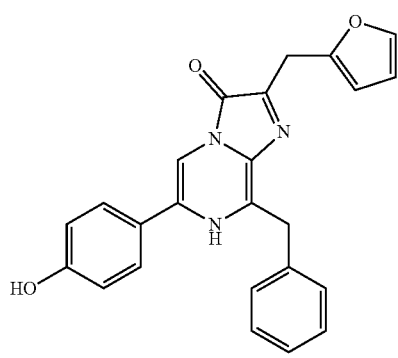
3945
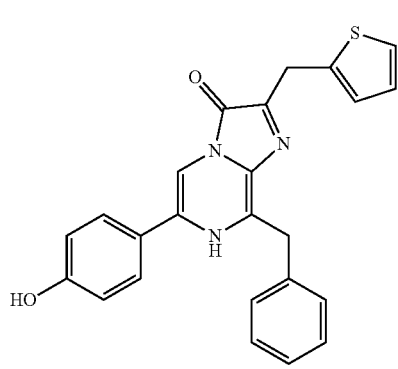
4002
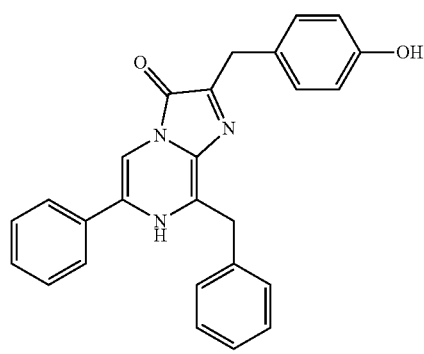
3840
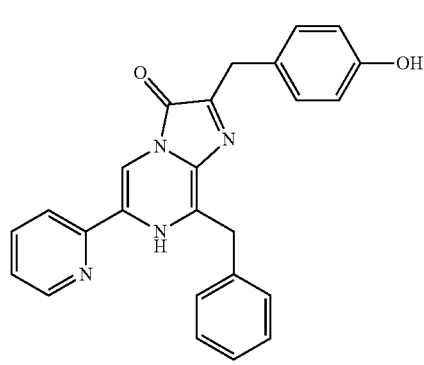
3886
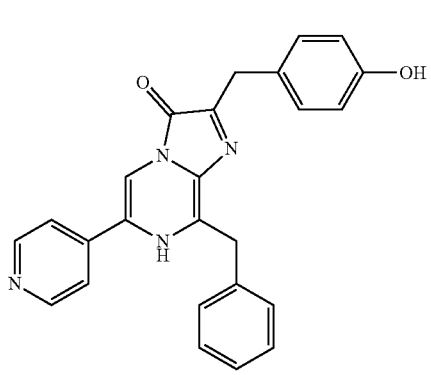
3857
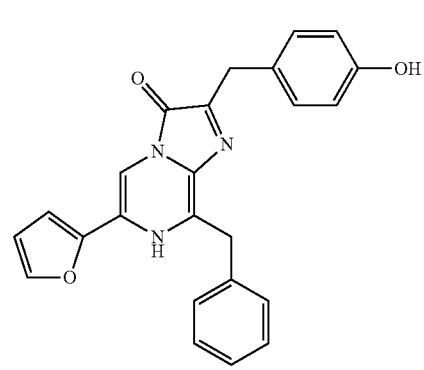
3887

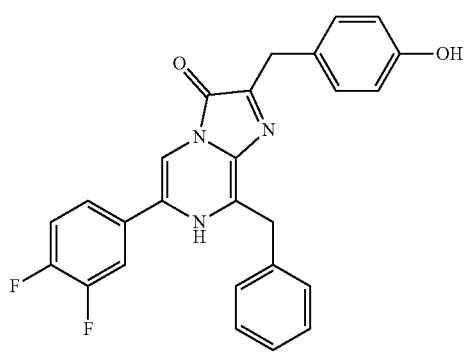
3913
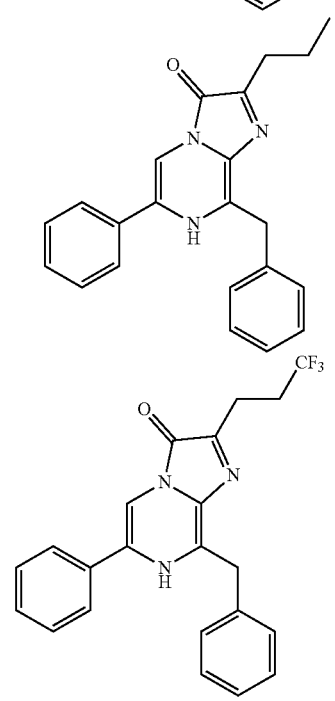
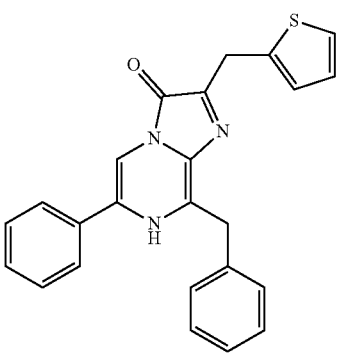
3889
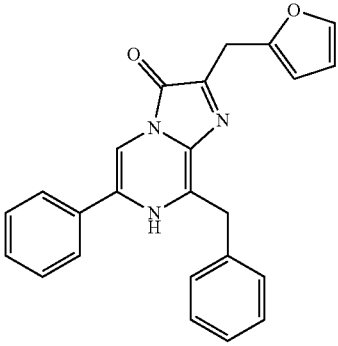
3939
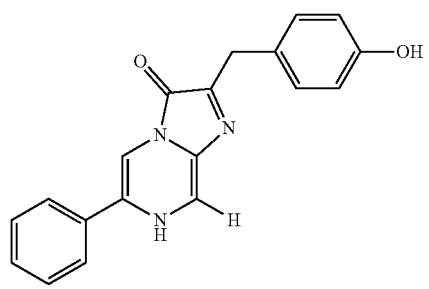
3894
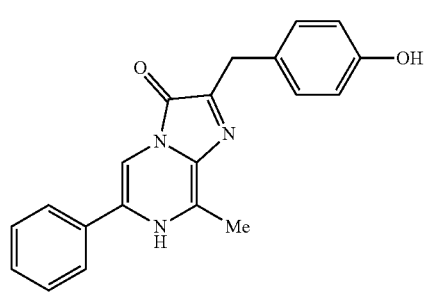
3896
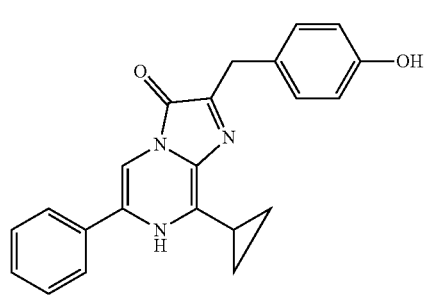
3897

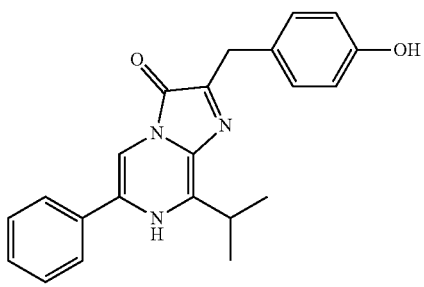

3841

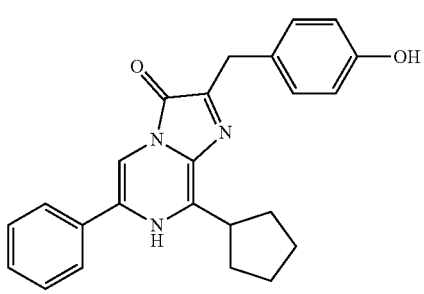

3842

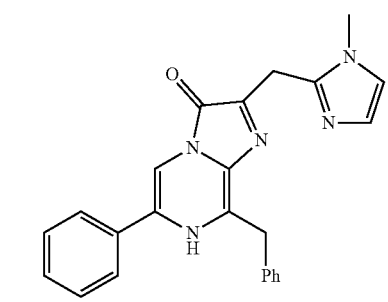

4525

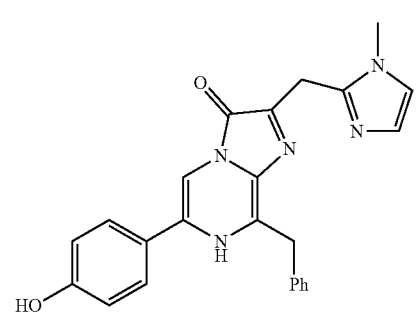

4540

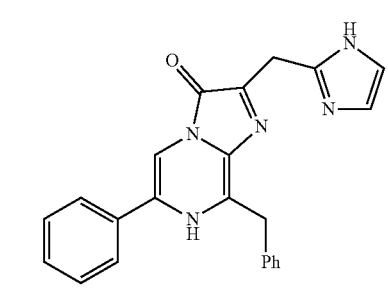

4541

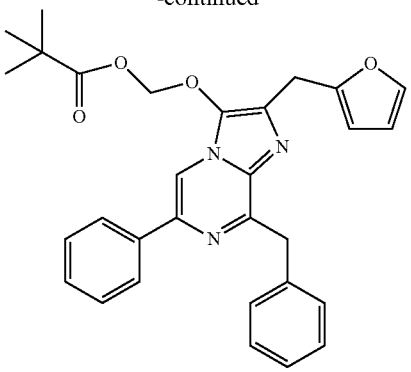

Isomers, Salts and Protected Forms

Certain compounds may exist in one or more particular geometric, optical, enantiomeric, diasteriomeric, epimeric, stereoisomeric, tautomeric, conformational, or anomeric forms, including but not limited to, cis- and trans-forms; E- and Z-forms; c-, t-, and r-forms; endo and exo-forms; R-, S-, and meso-forms; D- and L-forms; d- and l-forms; (+) and (−) forms; keto-, enol-, and enolate-forms; syn- and anti-forms; synclinal- and anticlinal-forms; α- and β-forms; axial and equatorial forms; boat-, chair-, twist-, envelope-, and half-chair forms; and combinations thereof, hereinafter collectively referred to as "isomers" (or "isomeric forms").

Note that, except as discussed below for tautomeric forms, specifically excluded from the term "isomers", as used herein, are structural (or constitutional) isomers (i.e., isomers which differ in the connections between atoms rather than merely by the position of atoms in space). For example, a reference to a methoxy group, —OCH$_3$, is not to be construed as a reference to its structural isomer, a hydroxymethyl group, —CH$_2$OH. Similarly, a reference to ortho-chlorophenyl is not to be construed as a reference to its structural isomer, meta-chlorophenyl. However, a reference to a class of structures may well include structurally isomeric forms falling within that class (e.g., $C_{1-7}$ alkyl includes n-propyl and iso-propyl; butyl includes n-, iso-, sec-, and tert-butyl; methoxyphenyl includes ortho-, meta-, and paramethoxyphenyl).

Note that specifically included in the term "isomer" are compounds with one or more isotopic substitutions. For example, H may be in any isotopic form, including $^1$H, $^2$H (D), and $^3$H (T); C may be in any isotopic form, including 12C, $^{13}$C, and $^{14}$C; O may be in any isotopic form, including $^{16}$O and $^{18}$O; and the like.

Unless otherwise specified, a reference to a particular compound includes all such isomeric forms, including (wholly or partially) racemic and other mixtures thereof. Methods for the preparation (e.g., asymmetric synthesis) and separation (e.g., fractional crystallization and chromatographic means) of such isomeric forms are either known in the art or are readily obtained by adapting the methods taught herein, or known methods, in a known manner Unless otherwise specified, a reference to a particular compound also includes ionic, salt, solvate, and protected forms of thereof, for example, as discussed below. It may be convenient or desirable to prepare, purify, and/or handle a corresponding salt of the active compound, for example, a pharmaceutically-acceptable salt. Examples of pharmaceutically acceptable salts are discussed in Berge et al., *J. Pharm. Sci.*, 66:1-19 (1977).

For example, if the compound is anionic, or has a functional group which may be anionic (e.g., —COOH may be —COO—), then a salt may be formed with a suitable cation. Examples of suitable inorganic cations include, but are not limited to, alkali metal ions such as $Na^+$ and $K^+$, alkaline earth cations such as $Ca^{2+}$ and $Mg^{2+}$, and other cations such as $Al^{3+}$. Examples of suitable organic cations include, but are not limited to, ammonium ion (i.e., $NH^{4+}$) and substituted ammonium ions (e.g., $NH_3R^+$, $NH_2R_2^+$, $NHR_3^+$, $NR_4^+$). Examples of some suitable substituted ammonium ions are those derived from: ethylamine, diethylamine, dicyclohexylamine, triethylamine, butylamine, ethylenediamine, ethanolamine, diethanolamine, piperazine, benzylamine, phenylbenzylamine, choline, meglumine, and tromethamine, as well as amino acids, such as lysine and arginine. An example of a common quaternary ammonium ion is $N(CH_3)_4^+$.

If the compound is cationic, or has a functional group which may be cationic (e.g., —$NH_2$ may be —$NH_3^+$), then a salt may be formed with a suitable anion. Examples of suitable inorganic anions include, but are not limited to, those derived from the following inorganic acids: hydrochloric, hydrobromic, hydroiodic, sulfuric, sulfurous, nitric, nitrous, phosphoric, and phosphorous. Examples of suitable organic anions include, but are not limited to, those derived from the following organic acids: acetic, propionic, succinic, glycolic, stearic, palmitic, lactic, malic, pamoic, tartaric, citric, gluconic, ascorbic, maleic, hydroxymaleic, phenylacetic, glutamic, aspartic, benzoic, cinnamic, pyruvic, salicyclic, sulfanilic, 2-acetyoxybenzoic, fumaric, phenylsulfonic, toluenesulfonic, methanesulfonic, ethanesulfonic, ethane disulfonic, oxalic, pantothenic, isethionic, valeric, lactobionic, and gluconic. Examples of suitable polymeric anions include, but are not limited to, those derived from the following polymeric acids: tannic acid, carboxymethyl cellulose.

It may be convenient or desirable to prepare, purify, and/or handle a corresponding solvate of the active compound. The term "solvate" is used herein in the conventional sense to refer to a complex of solute (e.g., active compound, salt of active compound) and solvent. If the solvent is water, the solvate may be conveniently referred to as a hydrate, for example, a mono-hydrate, a di-hydrate, a tri-hydrate, etc.

It may be convenient or desirable to prepare, purify, and/or handle the active compound in a chemically protected form. The term "chemically protected form", as used herein, pertains to a compound in which one or more reactive functional groups are protected from undesirable chemical reactions, that is, are in the form of a protected or protecting group (also known as a masked or masking group or a blocked or blocking group). By protecting a reactive functional group, reactions involving other unprotected reactive functional groups can be performed, without affecting the protected group; the protecting group may be removed, usually in a subsequent step, without substantially affecting the remainder of the molecule. See, for example, Protective Groups in Organic Synthesis (T. Green and P. Wuts, Wiley, 1999).

For example, a hydroxy group may be protected as an ether (—OR) or an ester (—OC(=O)R), for example, as: a t-butyl ether; a benzyl, benzhydryl (diphenylmethyl), or trityl (triphenylmethyl)ether; a trimethylsilyl or t-butyldimethylsilyl ether; or an acetyl ester (—OC(=O)$CH_3$, —OAc). For example, an aldehyde or ketone group may be protected as an acetal or ketal, respectively, in which the carbonyl group (>C=O) is converted to a diether (>C(OR)$_2$), by reaction with, for example, a primary alcohol. The aldehyde or ketone group is readily regenerated by hydrolysis using a large excess of water in the presence of acid. For example, an amine group may be protected, for example, as an amide or a urethane, for example, as: a methyl amide (—NHCO—$CH_3$); a benzyloxy amide (—NHCO—$OCH_2C_6H_5$, —NHCbz); as a t-butoxy amide (—NHCO—$OC(CH_3)_3$, —NH-Boc); a 2-biphenyl-2-propoxy amide (—NHCO—$OC(CH_3)_2C_6H_4C_6H_5$, —NH-Bpoc), as a 9-fluorenylmethoxy amide (—NH-Fmoc), as a 6-nitroveratryloxy amide (—NH-Nvoc), as a 2-trimethylsilylethyloxy amide (—NH-Teoc), as a 2,2,2-trichloroethyloxy amide (—NH-Troc), as an allyloxy amide (—NH-Alloc), as a 2(-phenylsulphonyl)ethyloxy amide (—NH-Psec); or, in suitable cases, as an N-oxide.

For example, a carboxylic acid group may be protected as an ester for example, as: an $C_{1-7}$ alkyl ester (e.g., a methyl ester; a t-butyl ester); a $C_{1-7}$ haloalkyl ester (e.g., a $C_{1-7}$ trihaloalkylester); a tri$C_{1-7}$ alkylsilyl-$C_{1-7}$ alkyl ester; or a $C_{5-20}$ aryl-$C_{1-7}$ alkyl ester (e.g., a benzyl ester; a nitrobenzyl ester); or as an amide, for example, as a methyl amide.

For example, a thiol group may be protected as a thioether (—SR), for example, as: a benzyl thioether; an acetamidomethyl ether (—S—$CH_2NHC(=O)CH_3$).

Synthesis of Coelenterazine Derivatives

Coelenterazine derivatives according to the present invention may be synthesized according those methods detailed in Examples 1-16.

Mutant *Oplophorus* Luciferases

In embodiments of the present invention, various techniques as described herein were used to identify sites for amino acid substitution to produce an improved synthetic OgLuc polypeptide. Additional techniques were used to optimize codons of the polynucleotides encoding the various polypeptides in order to enhance expression of the polypeptides. It was found that making one or more amino acid substitutions, either alone or in various combinations, produced synthetic OgLuc-type polypeptides having enhanced luminescence (e.g., enhanced brightness, enhanced signal stability, enhanced enzyme stability, and/or change in relative substrate specificity). Furthermore, including one or more codon-optimizing substitutions in the polynucleotides which encode for the various synthetic OgLuc variant polypeptides produced enhanced expression of the polypeptides in various eukaryotic and prokaryotic expression systems. One embodiment of the present invention is a polynucleotide that encodes a synthetic OgLuc variant polypeptide which is soluble and active in the monomeric form when expressed in prokaryotic and/or eukaryotic cells.

The OgLuc variants of the present invention may be coupled to any protein of interest or molecule of interest. In some embodiments, the variants are fusion proteins, for example some variants are coupled to a HaloTag® polypeptide attached at either the N-terminus or the C-terminus. Unless otherwise noted, the variants that are HaloTag® fusions include 'HT7' as part of the name, e.g., 'IVY-HT7'. In some embodiments, a signal sequence (e.g., the naturally-occurring *Oplophorus gracilirostris* signal sequence) is attached to the N-terminus of the fusion protein to facilitate the secretion of the fusion protein from the cell. Signal sequences, other than the naturally-occurring signal sequence of OgLuc luciferase, are known in the art to facilitate protein secretion in mammalian cells or other cell types. Signal sequences, in combination with membrane anchoring sequences, may be used to position or display OgLuc variants on the outer surface of the cellular membrane. Other methods, known in the art may also be used to position OgLuc variants to the membrane or other locations within the cell.

In some embodiments, the invention provides a modified decapod luciferase which has enhanced luminescence relative to a corresponding parental variant decapod luciferase. For example, the parental, variant OgLuc is C1+A4E, IVY, IV, QC27, QC27-9a, 9B8, 9B8 opt+K33N, 9B8 opt+K33N+ 170G, V2 or "L27V". In another embodiment, the invention provides a modified decapod luciferase which utilizes a novel coelenterazine. In one embodiment, the modified decapod luciferase has a change in relative specificity for native, known or novel coelenterazines. In one embodiment, the modified decapod luciferase has a change in relative specificity relative to a corresponding parental, variant decapod luciferase.

In some embodiments, the corresponding parental, variant decapod luciferase is a decapod species, including various species from families within the decapod order including, without limitation, luciferases of the Aristeidae family, including *Plesiopenaeus coruscans*; the Pandalidea family, including *Heterocarpus* and *Parapandalus richardi*, the Solenoceridae family, including *Hymenopenaeus debilis* and *Mesopenaeus tropicalis*; the Luciferidae family, including *Lucifer typus*; the Sergestidae family, including *Sergestes atlanticus, Sergestes arcticus, Sergestes armatus, Sergestes pediformis, Sergestes cornutus, Sergestes edwardsi, Sergestes henseni, Sergestes pectinatus, Sergestes sargassi, Sergestes similis, Sergestes vigilax, Sergia challengeri, Sergia grandis, Sergia lucens, Sergia prehensilis, Sergia potens, Sergia robusta, Sergia scintillans,* and *Sergia splendens*; the Pasiphaeidae family, including *Glyphus marsupialis, Leptochela bermudensis, Parapasiphae sulcatifrons,* and *Pasiphea tarda*; the Oplophoridae family, including *Acanthephyra acanthitelsonis, Acanthephyra acutifrons, Acanthephyra brevirostris, Acanthephyra cucullata, Acanthephyra curtirostris, Acanthephyra eximia, Acanthephyra gracilipes, Acanthephyra kingsleyi, Acanthephyra media, Acanthephyra microphthalma, Acanthephyra pelagica, Acanthephyra prionota, Acanthephyra purpurea, Acanthephyra sanguinea, Acanthephyra sibogae, Acanthephyra stylorostratis, Ephyrina bifida, Ephyrina figueirai, Ephyrina koskynii, Ephyrina ombango, Hymenodora glacialis, Hymenodora gracilis, Meningodora miccyla, Meningodora mollis, Meningodora vesca, Notostomus gibbosus, Notostomus auriculatus, Oplophorus gracilirostris, Oplophorus grimaldii, Oplophorus novaezealandiae, Oplophorus spinicauda, Oplophorus foliaceus, Oplophorus spinosus, Oplophorus typus, Systellaspis braueri, Systellaspis cristata, Systellaspis debilis,* and *Systellaspis pellucida*; and the Thalassocaridae family, including *Chlorotocoides spinicauda, Thalassocaris crinita,* and *Thalassocaris lucida*. In certain embodiments, the modified luciferase has increased luminescence emission, e.g., at least 1.3-fold, at least 2-fold, or at least 4-fold, in a prokaryotic cell and/or a eukaryotic cell relative to the corresponding wild-type luciferase. In some embodiments, one or more properties of the modified decapod luciferase is compared to comparable properties of a luciferase from another species, e.g., a firefly luciferase or a *Renilla* luciferase.

In some embodiments, the OgLuc variant has at least 60%, e.g., at least 65%, 70%, 75%, 80%, 85%, 90%, 95%, 96%, 97%, 98%, or 99%, or 100%, amino acid sequence identity to SEQ ID NOs: 3, 5, 7, 9, 11, 13, 15, 17, 19, 21, 27, 35, 37, 39, 41, 43, 45, 47, 49, 51, 53, 56, 58, 60, 62, 64, 69, 71, 73, 75, 77, 79, 81, 83, 85, 87, 89, 91, 93, or 95. In some embodiments, the OgLuc variant, or a functional fragment thereof, has no more than 5 differences, or more preferably, no more than 4, 3, 2, or 1 difference, or most preferably no differences, wherein the differences occur in positions corresponding to pattern position 1, 2, 3, 5, 8, 10, 12, 14, 15, 17, or 18 of Formula (VII) according to Table 4. Differences may also include gaps or insertions between the pattern positions of Table 4.

In some embodiments, the OgLuc variant of the invention has one or more heterologous amino acid sequences at the N-terminus, C-terminus, or both (a fusion polypeptide such as one with an epitope or fusion tag), which optionally directly or indirectly interact with a molecule of interest. In some embodiments, the presence of the heterologous sequence(s) does not substantially alter the luminescence of the OgLuc variant either before or after the interaction with the molecule of interest. In some embodiments, the heterologous amino acid sequence is an epitope tag. In some embodiments, the heterologous amino acid sequence is one which, during or after interaction with a molecule of interest, undergoes a conformational change, which in turn alters the activity of the OgLuc variant e.g., an OgLuc variant with such an amino acid sequence is useful to detect allosteric interactions. The OgLuc variant or a fusion with the OgLuc variant or a fragment thereof may be employed as a reporter.

In some embodiments, a fragment of an OgLuc variant of the invention is fused to a heterologous amino acid sequence, the fusion thereby forming a beta-barrel, which fusion protein is capable of generating luminescence from a naturally-occurring coelenterazine or an analog thereof including the various known coelenterazines discussed herein, or a novel coelenterazine of the present invention.

Also provided is a polynucleotide encoding an OgLuc variant of the invention or a fusion thereof, an isolated host cell having the polynucleotide or the OgLuc variant or a fusion thereof, and methods of using the polynucleotide, OgLuc variant or a fusion thereof or host cell of the invention.

The term "identity," in the context of two or more nucleic acids or polypeptide sequences, refers to two or more sequences or subsequences that are the same or have a specified percentage of amino acid residues or nucleotides that are the same when compared and aligned for maximum correspondence over a comparison window or designated region as measured using any number of sequence comparison algorithms or by manual alignment and visual inspection. Methods of alignment of sequence for comparison are well-known in the art. Optimal alignment of sequences for comparison can be conducted by the algorithm of Smith et al., (*J. Mol. Biol.* 147:195-197 (1981)), by the homology alignment algorithm of Needleman and Wunsch, (*J. Mol. Biol.*, 48:443-453 (1970)), by the search for similarity method of Pearson and Lipman, (*Proc. Natl. Acad. Sci. USA*, 85:2444-2448 (1988)), by computerized implementations of algorithms e.g., FASTA, SSEARCH, GGSEARCH (available at the University of Virginia FASTA server by William R. Pearson http://fasta.bioch.virginia.edu/fasta_www2/ fasta_intro.shtml), the Clustal series of programs (Chenna et al., *Nucl. Acids Res.* 31(13):3497-3500 (2003); available examples at http://www.ebi.ac.uk or http://www.ch.embnet.org), or other sequence analysis software. It is known in the art that generating alignments with maximum correspondence between polypeptide sequences with significant sequence alterations (e.g., altered domain order, missing/ added domains, repeated domains, shuffled domains, circular permutation) may involve the use of specialized methods, such as the ABA method (Raphael et al., *Genome Res.* 14(11):2336-2346 (2004)), other suitable methods, or performing the alignment with two concatenated identical copies of the polypeptide sequences.

The term "nucleic acid molecule," "polynucleotide" or "nucleic acid sequence" as used herein, refers to nucleic acid, including DNA or RNA, that comprises coding sequences necessary for the production of a polypeptide or protein precursor. The encoded polypeptide may be a full-length polypeptide, a fragment thereof (less than full-length), or a fusion of either the full-length polypeptide or fragment thereof with another polypeptide, yielding a fusion polypeptide.

A polynucleotide encoding a protein or polypeptide means a nucleic acid sequence comprising the coding region of a gene, or in other words, the nucleic acid sequence encoding a gene product. The coding region may be present in a cDNA, genomic DNA or RNA form. When present in a DNA form, the oligonucleotide may be single stranded (e.g., the sense strand) or double stranded. Suitable control elements such as enhancers/promoters, splice junctions, polyadenylation signals, etc. may be placed in close proximity to the coding region of the gene if needed to permit proper initiation of transcription and/or correct processing of the primary RNA transcript. Other control or regulatory elements include, but are not limited to, transcription factor binding sites, splicing signals, polyadenylation signals, termination signals and enhancer elements.

By "peptide," "protein" and "polypeptide" is meant amino acid chains of varying lengths, regardless of post-translational modification (e.g., glycosylation or phosphorylation). The nucleic acid molecules of the invention encode a variant of a man made (i.e., synthetic) variant protein or polypeptide fragment thereof, which has an amino acid sequence that is at least 60%, e.g., at least 65%, 70%, 75%, 80%, 85%, 90%, 95%, 96%, 97%, 98%, 99%, or 100%, amino acid sequence identity to the amino acid sequence of the parental protein from which it is derived, where the parental protein can be a naturally-occurring (native or wild-type) sequence or a variant sequence which is subsequently modified further. The term "fusion polypeptide" or "fusion protein" refers to a chimeric protein containing a reference protein (e.g., OgLuc variant) joined at the N- and/or C-terminus to one or more heterologous sequences (e.g., a non-OgLuc polypeptide). The heterologous sequence can include, but is not limited to, reporter proteins such as the HALOTAG® fusion protein (Promega Corp.), FlAsH fluorescein arsenical helix binder), and ReAsH (red arsenical helix binder) (e.g., LUMIO™ tag recognition sequence (Invitrogen)), chloramphenicol acetyltransferase (CAT), β-galactosidase (β-Gal), lactamase (P-gal), neomycin resistance (Neo), GUS, galactopyranoside, green fluorescent protein (GFP), luciferase (e.g., a *Renilla reniformis* luciferase, a firefly luciferase (e.g., *Photinus pyralis* or *Photuris pennsylvanica*), or a click beetle luciferase (e.g., *Pyrophorus plagiophthalamus* or *Pyrearinus termitilluminans*) or a glowworm luciferase (e.g., *Phrixothrix hirtus*), xylosidase, thymidine kinase, arabinosidase and SNAP-tag, CLIP-tag, ACP-tag and MCP-tag (New England Biolabs). In one embodiment, a chimeric protein contains an OgLuc variant joined at the N-terminus to a HALOTAG® fusion protein (Promega Corp.). In another embodiment, a chimeric protein contains an OgLuc variant joined at the C-terminus to a HALOTAG® fusion protein.

Nucleic acids are known to contain different types of "mutations", which refers to an alteration in the sequence of a nucleotide at a particular base position relative to the wild-type sequence. Mutations may also refer to insertion or deletion of one or more bases so that the nucleic acid sequence differs from a reference, e.g., a wild-type sequence, or replacement with a stop codon. A "substitution" refers to a change in an amino acid at a particular position in a sequence, e.g., a change from A to E at position 4.

The term "vector" refers to nucleic acid molecules into which fragments of DNA may be inserted or cloned and can be used to transfer DNA segment(s) into a cell and capable of replication in a cell. Vectors may be derived from plasmids, bacteriophages, viruses, cosmids, and the like.

The term "wild-type" or "native" as used herein, refers to a gene or gene product that has the characteristics of that gene or gene product isolated from a naturally occurring source. A wild-type gene is that which is most frequently observed in a population and is thus arbitrarily designated the "wild-type" form of the gene. In contrast, the term "mutant" refers to a gene or gene product that displays modifications in sequence and/or functional properties (i.e., altered characteristics) when compared to the wild-type gene or gene product. It is noted that naturally occurring mutants can be isolated; these are identified by the fact that they have altered characteristics when compared to the wild-type gene or gene product.

Exemplary Polynucleotides and Proteins

The invention includes an OgLuc variant or protein fragments thereof, e.g., those with deletions, for instance a deletion of 1 to about 5 residues, and chimeras (fusions) thereof (see U.S. Patent Publication No. 2009/0253131 and WIPO Publication No. WO 2007/120522, the disclosures of which are incorporated by reference herein) having at least one amino acid substitution relative to a wild-type OgLuc, which substitution results in the OgLuc variant having enhanced stability, enhanced luminescence, e.g., increased luminescence emission, greater stability of the luminescence kinetics, and/or altered luminescence color. The sequences of an OgLuc variant are substantially the same as the amino acid sequence of a corresponding wild-type OgLuc. A polypeptide or peptide having substantially the same sequence means that an amino acid sequence is largely, but is not entirely, the same and retains the functional activity of the sequence to which it is related. In general, two amino acid sequences are substantially the same if they are at least 60%, e.g., at least 65%, 70%, 75%, 80%, 85%, 90%, 95%, 96%, 97%, 98%, or 99%, but less than 100%, amino acid sequence identity. In some embodiments, the OgLuc variant is encoded by a recombinant polynucleotide. In some embodiments, the OgLuc variant, or a functional fragment thereof, has no more than 5 differences, or more preferably no more than 4, 3, 2, or 1 difference, or most preferably no differences, wherein the differences occur in positions corresponding to pattern position 1, 2, 3, 5, 8, 10, 12, 14, 15, 17, or 18 of Formula (VII) according to Table 4. Differences may also include gaps, insertions, or permutations between the pattern positions of Table 4.

The OgLuc variant proteins or fusion proteins of the invention may be prepared by recombinant methods or by solid phase chemical peptide synthesis methods. Such methods are known in the art.

Methods of Use and Kits

The compounds and proteins of the invention may be used in any way that luciferases and luciferase substrates, e.g., coelenterazines, have been used. For example, they may be used in a bioluminogenic method which employs an analog of coelenterazine to detect one or more molecules in a sample, e.g., an enzyme, a cofactor for an enzymatic reaction, an enzyme substrate, an enzyme inhibitor, an enzyme activator, or OH radicals, or one or more conditions, e.g., redox conditions. The sample may include an animal (e.g., a vertebrate), a plant, a fungus, physiological fluid (e.g., blood, plasma, urine, mucous secretions and the like), a cell, a cell lysate, a cell supernatant, or a purified fraction of a cell (e.g., a subcellular fraction). The presence, amount, spectral distribution, emission kinetics, or specific activity of such a molecule may be detected or quantified. The molecule may be detected or quantified in solution, including multiphasic solutions (e.g., emulsions or suspensions), or on solid supports (e.g., particles, capillaries, or assay vessels). In some embodiments the OgLuc variant can be used in luminescence-based assays to detect an enzyme of interest, e.g., CYP450 enzyme, MAO A or B enzyme, a caspase, etc. The novel coelenterazines could be used with photoproteins such as aequorin, obelin, or iPhotina. In some embodiment, the OgLuc variant can be used as an energy donor to another molecule (e.g., to a fluorophore, a chromophore, or a nanoparticle).

The invention also provides a polynucleotide encoding a transcriptional reporter. In some embodiments, the OgLuc variant or fragment thereof could be operably linked to transcription regulatory sequences, e.g., one or more enhancer, a promoter, a transcription termination sequence or a combination thereof, to form an expression cassette. For example, the OgLuc variant could be operably linked to a minimal promoter and a cAMP-response element (CRE).

The proteins of the invention may be used as biosensors, e.g., an OgLuc variant, which, in the presence of another molecule (e.g., one or more molecules of interest), or under certain conditions, has one or more altered activities. Upon interacting with a molecule of interest or being subject to certain conditions, the biosensor undergoes a conformational change or is chemically altered which causes an alteration of the enzyme activity or luminescence, e.g., specific activity, spectral distribution, or emission kinetics. For example, the OgLuc variant of the present invention, for example a circularly permuted variant, can comprise an interaction domain for a molecule of interest. Alternatively, for example, the OgLuc variant may be coupled to an energy acceptor, for example a fluorescent protein, and comprise an interaction domain that alters the efficiency of energy transfer from the enzyme to the energy acceptor. For example, the biosensor could be generated to detect proteases, kinases, a ligand, a binding protein such as an antibody, cyclic nucleotides such as cAMP or cGMP, or a metal such as calcium, by insertion of a suitable sensor region into the OgLuc variant sequence. One or more sensor region can be inserted at the C-terminus, the N-terminus, and/or at one or more suitable location in the polypeptide sequence, where the sensor region comprises one or more amino acids. In the case of a circularly-permuted OgLuc variant, the sensor region may be inserted between the N- and C-termini of the parent OgLuc variant. In addition, one or all of the inserted sensor regions may include linker amino acids to couple the sensor to the remainder of the OgLuc variant polypeptide. Examples of luciferase biosensors are disclosed in U.S. Pat. Appl. Publ. Nos. 2005/0153310 and 2009/0305280 and PCT Publ. No. WO 2007/120522 A2, each of which is incorporated by reference herein.

In various embodiments, the OgLuc variants disclosed herein may be used to transfer energy to an energy acceptor, for example in Bioluminescence Resonance Energy Transfer (BRET) analysis. For example, the OgLuc variants used in BRET analysis can be used to determine if two molecules are capable of binding each other or co-localize in a cell. For example, an OgLuc variant can be used as a bioluminescence donor molecule which is combined with a molecule or protein of interest to create a first fusion protein. In various embodiments, the first fusion protein contains an OgLuc variant and a protein of interest. In various embodiments, the first fusion proteins containing the OgLuc variant can be used in BRET analysis to detect protein/protein interaction in systems including but not limited to cell lysates, intact cells, and living animals. In various embodiments, HALOTAG® can be used as a fluorescent acceptor molecule. In some embodiments, HALOTAG® can be fused to a second protein of interest or to an OgLuc variant. For example, an OgLuc variant can be fused to HALOTAG®, expressed in cells or animals, and labeled with a fluorescent HALOTAG® ligand such as HALOTAG® TMR ligand. The fusion can subsequently be excited to fluoresce in the presence of a cell-permeant OgLuc substrate. In some embodiments, BRET may be performed using OgLuc variants in combination with fluorescent proteins, including but not limited to Green Fluorescent Protein (GFP) or Red Fluorescent Protein (RFP) or fluorescent labels including fluorescein, rhodamine green, Oregon green, or Alexa 488, to name a few non-limiting examples.

In various embodiments, the OgLuc variants and/or the novel coelenterazines of the present invention may be used in protein complementation assays (PCA) to detect the interaction of two biomolecules, e.g., polypeptides. For example, an OgLuc variant of the present invention can be separated into two fragments at a site(s) tolerant to separation and each fragment of the separated OgLuc variant can be fused to one of a pair of polypeptides of interest believed to interact, e.g., FKBP and FRB. If the two polypeptides of interest do in fact interact, the OgLuc fragments then come into close proximity with each other to reconstitute the functional, active OgLuc variant. In some embodiments, the activity of the reconstituted OgLuc variant can then be detected and measured using a native or known coelenterazine or a novel coelenterazine of the present invention. In some embodiments, the split OgLuc variant can be used in a more general complementation system similar to lac-Z (Langley et al., *PNAS* 72:1254-1257 (1975)) or ribonuclease S (Levit and Berger, *J. Biol. Chem.* 251:1333-1339 (1976)). In some embodiments, an OgLuc variant fragment (designated "A") known to complement with another OgLuc variant fragment ("B") can be fused to a target protein, and the resulting fusion can be monitored via luminescence in a cell or cell lysate containing fragment B. In some embodiments, the source of fragment B could be the same cell (e.g., if the gene for fragment B is integrated into the genome of the cell or is contained on another plasmid within the cell) or it could be a lysate or purified protein derived from another cell. In some embodiments, this same fusion protein (fragment A) could be captured or immobilized using a fusion between fragment B and a polypeptide such as HALOTAG® capable of attachment to a solid support. In some embodiments, luminescence can be used to demonstrate successful capture or to quantify the amount of material captured.

In various embodiments, the OgLuc variants and/or the novel coelenterazines of the present invention may be used to quantify coelenterazine. In some embodiments, a coelenterazine (e.g., a native or known coelenterazine, or a novel coelenterazine of the present invention) can be used as a probe of a specific biochemical activity, e.g., apoptosis and drug metabolism. In some embodiments, the coelenterazine concentration is coupled to a specific enzyme activity by a "pro-coelenterazine" or "pro-substrate" that can be acted on by the specific enzyme of interest. In some embodiments, the pro-coelenterazine is a molecule that cannot support luminescence directly when combined with luciferase, but can be converted into coelenterazine through catalytic processing by a specific enzyme of interest. In some embodiments, the approach can be used for enzymes such as those used in drug metabolism, e.g., cytochrome P450 enzymes, monoamine oxidase, and glutathione S-transferase; and apoptosis, e.g., caspases. For example, coelenterazine (e.g., a native or known coelenterazine, or a novel coelenterazine of the present invention) can be modified to contain a cleavable group, such as 6'-O-methyl. In some embodiments, when incubated with a specific cytochrome P450 enzyme, the 6'O-methyl is cleaved, and the pro-coelenterazine converted to coelenterazine which can be detected with an OgLuc variant of the present invention. In some embodiments, the pro-coelenterazine can be combined with other components necessary to support luminescence, e.g., luminescent protein such as an OgLuc variant of the present invention, to provide a single reagent and a homogeneous assay. For example, when the reagent is added to a sample, luminescence is generated as pro-coelenterazine is converted to coelenterazine. In various embodiments, similar assays can be developed for other enzymes, small molecules, or other cellular processes that can be linked to the generation of coelenterazines from pro-coelenterazines.

In various embodiments, the OgLuc variants and/or the novel coelenterazines of the present invention may be used as genetic transcriptional reporter systems. In some embodiments, the OgLuc variants can be multiplexed with a luciferase that emits light at a different wavelength, e.g., red click beetle luciferase (CHROMA-LUC™; Promega Corp.). For example, if an OgLuc variant of the present invention is used as a functional reporter, then the red CHROMA-LUC™ luciferase could be used to control for non-specific effects on genetic regulation or to normalize for transfection efficiency. In some embodiments, luminescence generated from the OgLuc variant (approximately 460 nm) and red CHROMA-LUC™ (approximately 610 nm) can be easily resolved using a luminometer with wavelength-discriminating filters, enabling the measurement of both signals from the same sample. In another example, an OgLuc variant of the present invention could be used as a transcriptional reporter and paired with a luciferase that emits light at a different wavelength contained in an assay reagent. For example, an OgLuc variant of the present invention could be used as transcriptional reporter and paired with either aequorin or a cAMP circularly-permuted firefly luciferase biosensor, or both simultaneously, to detect multiple pathways in a single sample. In such a system, for example, aequorin could be used for the detection and/or measurement of calcium, the biosensor for the detection and/or measurement of cAMP, and an OgLuc variant for monitoring of downstream gene expression. In another example, an OgLuc variant may be used with one or more additional luciferases, where the luminescence of each luciferase may be separately measured through the use of selective enzyme inhibitors. For example, the luminescence of a first luciferase may be measured upon addition of appropriate substrates and buffers, followed by measurement of a second luciferase upon a subsequent addition of appropriate substrates and buffers and one or more inhibitors selective for the first luciferase. In another example, the luciferase contained in an assay reagent may be used for measuring a specific aspect of cellular physiology, for example ATP to estimate cell viability, or caspase activity to estimate cellular apoptosis.

In various embodiments, the OgLuc variants of the present invention may be used as reporters in difficult to transfect cell lines or perhaps even in non-dividing primary cells, e.g., stem cells or HepG2 cells. Due to their high signal intensity, the OgLuc variants of the present invention will enable detectable luminescence when transfection efficiency is low. In some embodiments, the OgLuc variants can be used as reporters in cells that are especially sensitive to conditions associated with transfection, e.g., which are sensitive to elevated DNA concentrations or the addition of transfection reagent. Thus, in various embodiments, due to the enhanced luminescence of the OgLuc variants of the present invention, an adequate level of luminescence can be achieved using lower DNA concentrations, less transfection reagent, and/or shorter post-transfection times prior to beginning an assay so that there is a reduced toxicity burden on sensitive cells. In various embodiments, the enhanced luminescence of the OgLuc variants will also allow for a signal to be detected at much later time points. In still other embodiments, the OgLuc variants could be used as reporters for single-copy native promoters.

In various embodiments, the OgLuc variants of the present invention may be used as fusion tags for a target protein of interest as a way to monitor intracellular levels of the target protein. In some embodiments, the OgLuc variants can be used to monitor specific proteins involved in stress response pathways (e.g., DNA damage, oxidative stress, inflammation) in cells as a way to probe the role various types of stimuli may play in these pathways. In some embodiments, the OgLuc variants can also be used as a means to monitor cellular trafficking of a target protein. For example, the OgLuc variants can also be fused to viral genomes (e.g., HIV, HCV) so that titer levels, i.e., infectivity, can be monitored in cells following treatment with potential antiviral agents. In some embodiments, the variants can also be fused to green fluorescent protein (GFP) or HALOTAG® (in addition to a target protein) for fluorescence activated cell sorting (FACS) to identify high expression clones.

In various embodiments, identification of robust, stable cell lines expressing an OgLuc variant of the present invention, either in the cytoplasm or as a secreted form, can be facilitated by the enhanced signal of the OgLuc variant and the small size of the OgLuc gene. The relatively small gene sequence should reduce the likelihood of genetic instability resulting from the integration of the foreign DNA into a cell's genome.

In various embodiments, the OgLuc variants of the present invention can be integrated into a variety of different immunoassay concepts. For example, an OgLuc variant can be fused to a primary or secondary antibody to provide a method of detection for a particular analyte. As another example, an OgLuc variant can be fused to protein A or protein G, and the fusion could then be used to detect a specific antibody bound to a particular analyte. As another example, an OgLuc variant can be fused to streptavidin and used to detect a specific biotinylated antibody bound to a particular analyte. As yet another example, complementary fragments of an OgLuc variant can be fused to primary and secondary antibodies, where the primary antibody recognizes a particular analyte, and the secondary antibody recognizes the primary antibody. In some embodiments, the OgLuc variant activity would be reconstituted in the presence of analyte. As still another example, an OgLuc variant can be conjugated to an analyte (e.g., prostaglandins) and used in a competitive sandwich ELISA format. The OgLuc variant conjugated to an analyte may also be used to detect antibodies capable of binding the analyte, where the binding activity allows the OgLuc variant to be selectively linked to the antibody. An example using *Renilla* luciferase for quantitatively measuring patient antibody titers to an antigenic target is the Luciferase Immunoprecipitation System (Burbelo et al., Expert Review of Vaccines 9(6):567-578 (2010))

In various embodiments, the OgLuc variants and novel substrates of the present invention can be used for detecting luminescence in live cells. In some embodiments, an OgLuc variant can be expressed in cells (as a reporter or otherwise), and the cells treated with a coelenterazine, e.g., a novel coelenterazine such as PBI-3939, which will permeate cells in culture, react with the OgLuc variant and generate luminescence. In addition to being cell permeant, PBI-3939 shows comparable biocompatibility to native coelenterazine in terms of cell viability. In some embodiments, a version of PBI-3939 containing chemical modifications known to increase the stability of native coelenterazine in media can be synthesized and used for more robust, live cell OgLuc variant-based reporter assays. In still other embodiments, a sample (including cells, tissues, animals, etc.) containing an OgLuc variant and/or a novel coelenterazine of the present invention may be assayed using various microscopy and imaging techniques. In still other embodiments, a secretable OgLuc variant is expressed in cells as part of a live-cell reporter system.

In various embodiments, the OgLuc variants and/or novel coelenterazines disclosed herein may be provided as part of a kit. The kit may include one or more OgLuc variants as disclosed herein (in the form of a polypeptide, a polynucleotide, or both) and/or a coelenterazine, along with suitable reagents and instructions to enable a user to perform assays such as those disclosed herein. The coelenterazine may be any of the native, known, or novel coelenterazines disclosed herein. The kit may also include one or more buffers, such as those disclosed herein.

Vectors and Host Cells Encoding the Modified Luciferase or Fusions Thereof

Once a desirable nucleic acid molecule encoding an OgLuc variant or a fragment thereof, such as one with luminescence activity or which may be complemented by another molecule to result in luminescence activity, or a fusion thereof with luminescence activity, is prepared, an expression cassette encoding the OgLuc variant or a fragment thereof, e.g., one for complementation, or a fusion thereof with luminescence activity, may be prepared. For example, a nucleic acid molecule comprising a nucleic acid sequence encoding an OgLuc variant is optionally operably linked to transcription regulatory sequences, e.g., one or more enhancers, a promoter, a transcription termination sequence or a combination thereof, to form an expression cassette. The nucleic acid molecule or expression cassette may be introduced to a vector, e.g., a plasmid or viral vector, which optionally includes a selectable marker gene, and the vector introduced to a cell of interest, for example, a prokaryotic cell such as *E. coli, Streptomyces* spp., *Bacillus* spp., *Staphylococcus* spp. and the like, as well as eukaryotic cells including a plant (dicot or monocot), fungus (including yeast, e.g., *Pichia, Saccharomyces* or *Schizosaccharomyces*), or a mammalian cell, lysates thereof, or to an in vitro transcription/translation mixture. Mammalian cells include but are not limited to bovine, caprine, ovine, canine, feline, non-human primate, e.g., simian, and human cells. Mammalian cell lines include, but are not limited to, CHO, COS, HEK293, HeLa, CV-1, SH-SY5Y, and NIH 3T3 cells, although numerous other cell lines can also be used as well.

The expression of an encoded OgLuc variant may be controlled by any promoter capable of expression in prokaryotic cells or eukaryotic cells including synthetic promoters. Prokaryotic promoters include, but are not limited to, SP6, T7, T5, tac, bla, trp, gal, lac or maltose promoters, including any fragment that has promoter activity. Eukaryotic promoters include, but are not limited to, constitutive promoters, e.g., viral promoters such as CMV, SV40 and RSV promoters, as well as regulatable promoters, e.g., an inducible or repressible promoter such as the tet promoter, the hsp70 promoter and a synthetic promoter regulated by CRE, including any fragment that has promoter activity. The expression of an encoded OgLuc variant may also be controlled by post-transcriptional processes, such as by regulation of RNA processing or regulation of translation, for example by RNAi, miRNA, shRNA, siRNA, or by RNA or protein degradation. The nucleic acid molecule, expression cassette and/or vector of the invention may be introduced to a cell by any method including, but not limited to, calcium-mediated transformation, electroporation, microinjection, lipofection, and the like.

Optimized Sequences, and Vectors and Host Cells Encoding the OgLuc Variants

Also provided is an isolated nucleic acid molecule (polynucleotide) comprising a nucleic acid sequence encoding an OgLuc variant of the invention, a functional fragment thereof or a fusion protein thereof. In some embodiments, the isolated nucleic acid molecule comprises a nucleic acid sequence which is optimized for expression in at least one selected host. Optimized sequences include sequences which are codon optimized, i.e., codons which are employed more frequently in one organism relative to another organism, e.g., a distantly related organism, as well as modifications to add or modify Kozak sequences and/or introns, and/or to remove undesirable sequences, for instance, potential transcription factor binding sites. Such optimized sequences can provide enhanced expression, e.g., increased levels of protein expression, when introduced into a host cell. Examples of optimized sequences are disclosed in U.S. Pat. No. 7,728,118 and U.S. Pat. Appl. Publ. Nos. 2008/0070299, 2008/0090291, and 2006/0068395, each of which is incorporated by reference herein.

In some embodiments, the polynucleotide includes a nucleic acid sequence encoding an OgLuc variant of the invention, which nucleic acid sequence is optimized for expression in a mammalian host cell. In some embodiments, an optimized polynucleotide no longer hybridizes to the corresponding non-optimized sequence, e.g., does not hybridize to the non-optimized sequence under medium or high stringency conditions. The term "stringency" is used in reference to the conditions of temperature, ionic strength, and the presence of other compounds, under which nucleic acid hybridizations are conducted. With "high stringency" conditions, nucleic acid base pairing will occur only between nucleic acid fragments that have a high frequency of complementary base sequences. Thus, conditions of "medium" or "low" stringency are often used when it is desired that nucleic acids that are not completely complementary to one another be hybridized or annealed together. The art knows well that numerous equivalent conditions can be employed to comprise medium or low stringency conditions.

In some embodiments, the polynucleotide has less than 90%, e.g., less than 80%, nucleic acid sequence identity to the corresponding non-optimized sequence and optionally encodes a polypeptide having at least 60%, e.g., at least 65%, 70%, 75%, 80%, 85%, 90%, 95%, 96%, 97%, 98%, 99%, or 100%, amino acid sequence identity with the polypeptide encoded by the non-optimized sequence. Constructs, e.g., expression cassettes, and vectors comprising the isolated nucleic acid molecule, e.g., with optimized nucleic acid sequence, as well as kits comprising the isolated nucleic acid molecule, construct or vector are also provided.

A nucleic acid molecule comprising a nucleic acid sequence encoding an OgLuc variant of the invention, a fragment thereof or a fusion thereof is optionally optimized for expression in a particular host cell and also optionally operably linked to transcription regulatory sequences, e.g., one or more enhancers, a promoter, a transcription termination sequence or a combination thereof, to form an expression cassette.

In some embodiments, a nucleic acid sequence encoding an OgLuc variant of the invention, a fragment thereof or a fusion thereof is optimized by replacing codons, e.g., at least 25% of the codons in a parental OgLuc sequence with codons which are preferentially employed in a particular (selected) cell. Preferred codons have a relatively high codon usage frequency in a selected cell, and preferably their introduction results in the introduction of relatively few transcription factor binding sites for transcription factors present in the selected host cell, and relatively few other undesirable structural attributes. Examples of undesirable structural attributes include, but not limited to, restriction enzyme sites, eukaryotic sequence elements, vertebrate promoter modules and transcription factor binding sites, response elements, E. coli sequence elements, mRNA secondary structure. Thus, the optimized nucleic acid product may have an improved level of expression due to improved codon usage frequency, and a reduced risk of inappropriate transcriptional behavior due to a reduced number of undesirable transcription regulatory sequences.

An isolated and optimized nucleic acid molecule may have a codon composition that differs from that of the corresponding wild-type nucleic acid sequence at more than 30%, 35%, 40% or more than 45%, e.g., 50%, 55%, 60% or more of the codons. Exemplary codons for use in the invention are those which are employed more frequently than at least one other codon for the same amino acid in a particular organism and, in some embodiments, are also not low-usage codons in that organism and are not low-usage codons in the organism used to clone or screen for the expression of the nucleic acid molecule. Moreover, codons for certain amino acids (i.e., those amino acids that have three or more codons), may include two or more codons that are employed more frequently than the other (non-preferred) codon(s). The presence of codons in the nucleic acid molecule that are employed more frequently in one organism than in another organism results in a nucleic acid molecule which, when introduced into the cells of the organism that employs those codons more frequently, is expressed in those cells at a level that is greater than the expression of the wild-type or parent nucleic acid sequence in those cells.

In some embodiments of the invention, the codons that are different are those employed more frequently in a mammal, while in still other embodiments, the codons that are different are those employed more frequently in a plant. Preferred codons for different organisms are known to the art, e.g., see http://www.kazusa.or.jp/codon/. A particular type of mammal, e.g., a human, may have a different set of preferred codons than another type of mammal. Likewise, a particular type of plant may have a different set of preferred codons than another type of plant. In one embodiment of the invention, the majority of the codons that differ are ones that are preferred codons in a desired host cell. Preferred codons for organisms including mammals (e.g., humans) and plants are known to the art (e.g., Wada et al., *Nucl. Acids Res.*, 18:2367 (1990); Murray et al., *Nucl. Acids Res.*, 17:477 (1989)).

EXAMPLES

Reference Example 1—Synthesis of α-Aminonitrile (Compound 1)

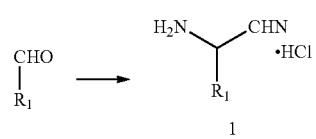

A flask was charged with sodium bisulfate (71.4 mmol) and 17 mL of water. To this, a solution of aldehyde (69.3 mmol) in 14 mL of tetrahydrofuran (THF) was added dropwise at a rate that kept the internal temperature below 60° C. The resulting suspension was stirred at ambient temperature for 40 min, and ammonium hydroxide solution (4.85 mL) added over 2 min. The resulting solution was magnetically stirred while being heated in an oil bath at 60° C. for 1 hr and then left at ambient temperature overnight. The solution was cooled in an ice/saltwater bath until the internal temperature measured below 5° C. To this, a solution of sodium cyanide (71.4 mmol) in 14 mL of water was added dropwise over 30 min. The resulting mixture was stirred at approximately 10° C. for 20 min, 30° C. for 2 hrs, and at ambient temperature for 18 hrs. The reaction mixture was extracted into three 200 mL portions of diethyl ether, and the combined extracts dried over anhydrous sodium sulfate. The mixture was filtered, and the solution cooled in an ice bath for 20 min. To the stirred solution, hydrogen chloride gas was added until precipitation ceased, and the suspension stirred for 1 hr. The solid was isolated by filtration and rinsed with three 50 mL portions of diethyl ether. The material was dried under vacuum, and 6.4 g (47.5 mmol) of a white solid was obtained (69%). Procedure was adapted from: Freifelder and Hasbrouck, "Synthesis of Primary 1,2-Diamines by Hydrogenation of alpha-Aminonitriles," *Journal of the American Chemical Society*, 82(3): 696-698 (1960).

Reference Example 2—Synthesis of 2-oxo-2-phenylacetaldehyde oxime (Compound 2)

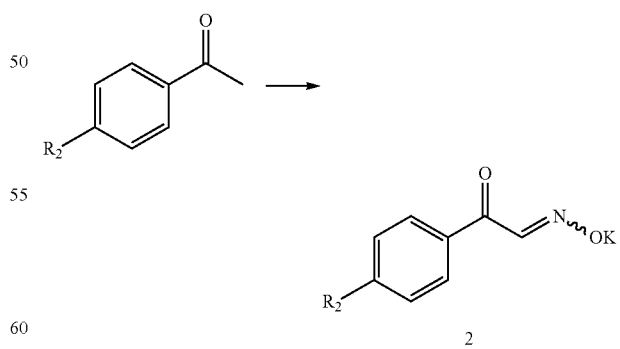

A flask was charged with potassium tert-butoxide (58 mmol) and 63 mL of tert-butyl alcohol. The mixture was stirred until a solution was formed, and a solution of the appropriate benzophenone (50 mmol) in 35 mL of tert-butyl alcohol added dropwise over 15 min. The reaction mixture was stirred for 1 hr, and the neat isoamyl nitrite (75 mmol) added over five min. The reaction mixture was monitored for completion and then diluted with 100 mL of heptanes. The resulting solid (38 mmol) was collected via suction filtration and dried to a constant weight under vacuum. Procedure was adapted from: Hagedorn et al., *Chem. Ber.*, 98:193 (1965).

Reference Example 3—Synthesis of Pyrazine Derivatives (Compound 3)

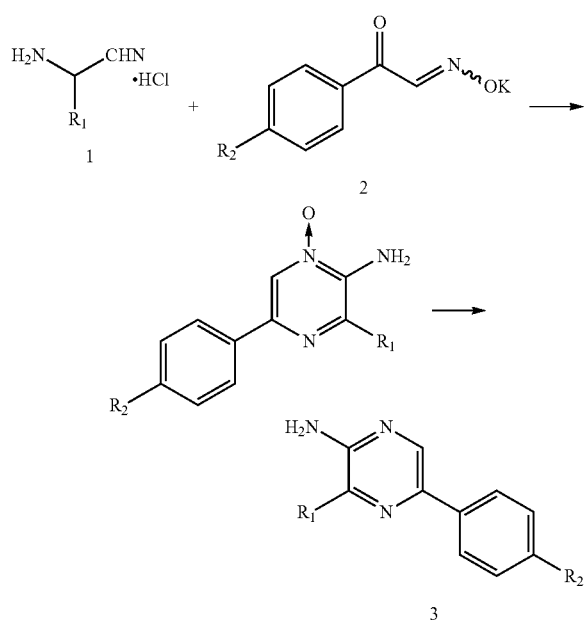

A 3-neck flask was fitted with a thermometer, septum, and argon line. To this, aminonitrile (47.5 mmol), dry pyridine (190 mL), and oxime (61.75 mmol) was added. The mixture was well stirred for 15 min, and tetra-chloro(bis-pyridyl) titanium complex (94.9 mmol) added in five portions over 35 min making sure the internal temperature remained below 40° C. After the addition was complete, the reaction mixture was stirred overnight at ambient temperature. The reaction mixture was slowly added to a solution of sodium bicarbonate (21.75 g in 174 mL water) in small portions. The resulting mixture was well stirred for 15 min and 80 g of celite was added. The suspension was stirred for 30 min and filtered through a Buchner funnel. The filtrate was removed to a separatory funnel, and the filter cake was suspended in 400 mL of methanol. The mixture was stirred for 30 min and filtered again. This process was repeated a total of four times. The methanolic filtrates were combined and concentrated, and the residue dissolved in 200 mL of ethyl acetate (EtOAc). The solution was added to the separatory funnel containing the original filtrate, and the mixture further extracted with three 100 mL portions of EtOAc. The combined extracts were washed with two 100 mL portions of saturated sodium carbonate and two 100 mL portions of brine solution. The organic solvent was evaporated, and the crude pyazine-oxide obtained as a brown oil. The material was dissolved in 3 mL of methanol, and 89 mL of dichloromethane (DCM) was added. To this solution, zinc dust (80.7 mmol) was added, and the mixture cooled in an ice bath until an internal temperature of 15° C. was reached. The mixture was treated with glacial acetic acid (3 mL) and warmed to an internal temperature of 30° C. in an oil bath for 40 min. The reaction mixture was cooled to room temperature and filtered through a pad of celite. The filter cake was rinsed with DCM, and the combined filtrates washed with an aqueous solution of saturated sodium bicarbonate. The crude product was purified by chromatography over silica gel using a heptane/EtOAc gradient. This gave 2.9 g (29%) of the pyrazine as a brown solid. Procedure was adapted from: Kishi et al., "The structure confirmation of the light-emitting moiety of bioluminescent jellyfish." *Tetrahedron Lett.*, 13(27):2747 (1972).

Reference Example 4—Synthesis of Coelenterazines

Method A:

(the following compounds can be synthesized by Method A: compounds PBI-3840, PBI-3886, PBI-3857, PBI-3887, PBI-3913, PBI-3894, PBI-3896, PBI-3897, PBI-3841 and PBI-3842)

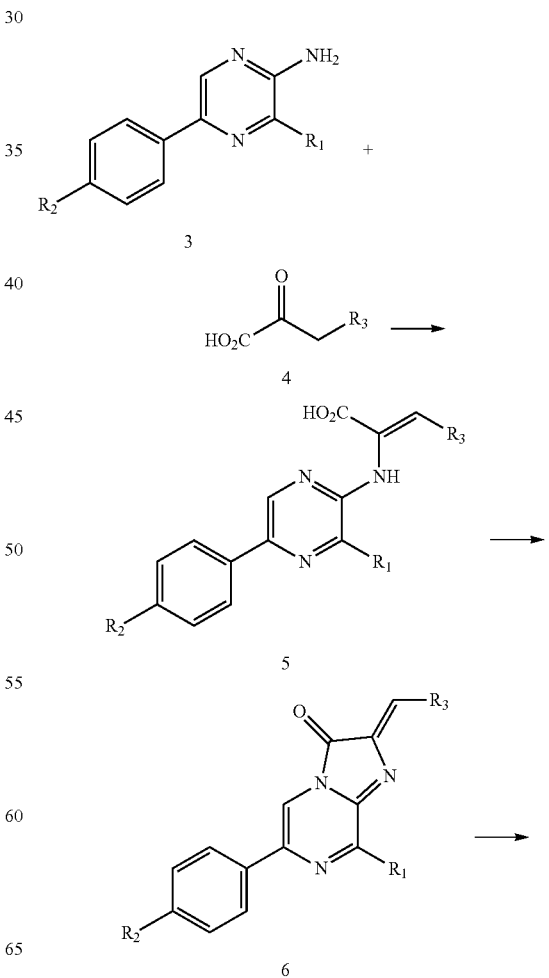

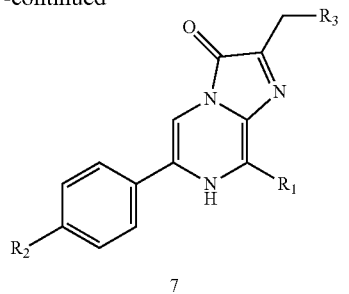

7

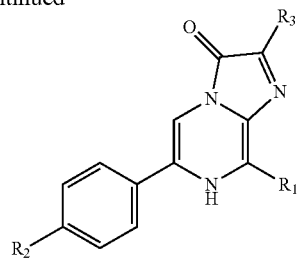

9

A flask was charged with pyrazine (8.25 mmol), pyruvic acid (14.0 mmol), camphor sulfonic acid (0.8 mmol), and anhydrous 2-methyl THF (150 mL). The flask was equipped with a condenser and soxhlet extractor charged with 4-angstrom molecular sieves, and the reaction mixture heated in an oil bath at 110° C. for 18 hrs. The sieves were replaced with fresh ones, and reflux continued for 24 hrs. The reaction mixture was filtered and concentrated, and the residue dissolved in EtOAc (200 mL). This solution was washed with three 25 mL portions of saturated sodium bicarbonate solution, 100 mL of 0.1 M sodium acetate buffer, pH 5, and 100 mL of brine solution. The solution was dried over magnesium sulfate, filtered, and concentrated to give 2.3 g (6.2 mmol, 75%) of the crude enamine/acid. This material was dissolved in anhydrous THF (30 mL), and the solution cooled in an ice/water bath for 10 min. To this, the carbodiimide (9.0 mmol) and neat diisopropylethyl amine (14.9 mmol) was added. The cold bath was removed after 10 min, and the reaction mixture stirred at ambient temperature for 3 hrs. To the reaction mixture, 50 mL of 0.1 M sodium acetate buffer, pH 5 was added, and the mixture well stirred for 10 min. The biphasic mixture was extracted with three 100 mL portions of EtOAc, and the combined extracts washed with brine solution. The organic solution was concentrated, and the residue purified by chromatography over silica gel using a DCM/methanol gradient. This gave 336 mg (0.94 mmol, 16%) of the dehydrocoelenterazine as a red solid. This material was suspended in 10 mL of methanol, and the mixture cooled in an ice bath. To this, sodium borohydride (100 mg, 2.6 mmol) was added in three portions over 1 hr. The reaction mixture was stirred for an additional 30 min, and neat glacial acetic acid added drop wise until a pH of 5 was reached. The solution was concentrated, and the residue triturated with 15 mL of water. The solid was isolated via suction filtration and dried under vacuum for several hours to give 318 mg (94%) of the crude coelenterazine as a yellow solid. Procedure was adapted from: Kakoi and Inoue, Chem. Lett. 11(3):299-300 (1980).

Method B:

(the following compounds can be synthesized by method B: compounds PBI-3882, PBI-3932, PBI-3881)

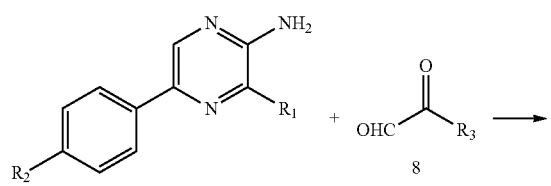

3

A flask was charged with the glyoxal (2.2 mmol), aminopyrazine (1.1 mmol), ethanol (20 mL), 12N HCl (0.6 mL), and water (1 mL). The reaction mixture was heated at reflux for 24 hrs and concentrated. The residue was purified by column chromatography over silica gel using a DCM/methanol gradient. This gave 100 mg (0.25 mmol, 23%) of the coelenterazine product as a dark solid. Procedure was adapted from: Inoue et al. "Squid bioluminescence. II. Isolation from *Watasenia scintillans* and synthesis of 2-(p-hydroxybenzyl)-6-(p-hydroxyphenyl)-3,7-dihydroimidazo [1,2-a]pyrazin-3-one." Chem. Lett., 4(2): 141-4 (1975).

Method C:

Synthesis of novel coelenterazines (the following compounds can be synthesized by method C: PBI-3939, PBI-3945, PBI-3889, PBI-4002)

The compound 4-(5-amino-6-benzylpyrazin-2-yl)phenol can be prepared according to previously described methods (Kishi et al., Tetrahedron Lett., 13:2747 (1972); Mosrin et al., Organic Letters, 11:3406 (2009); Kakoi, Chem. Pharm. Bull., 50:301 (2002)).

Synthesis of 2-amino-3-benzyl-5-phenylpyrazine

A round bottomed flask was charged with 5 g (33.5 mmol) of 2-isonitrosoacetophenone, 6.7 g (36.8 mmol) of 2-amino-3-phenylpropanenitrile hydrochloride and 100 mL of dry pyridine. The mixture was cooled to −20° C. and 4.6 mL (40.0 mmol) of $TiCl_4$ was added dropwise. The reaction was kept at −20° C. for 30 min and heated to 80° C. for 2.5 hrs. The solvent was evaporated, and the residue taken up in 1 L of DCM. This solution was washed with saturated $NaHCO_3$ and brine. All volatiles were evaporated, and the residue redissolved in ethanol (400 mL). Raney Ni (2.0 g, aqueous suspension) was added, and the reaction allowed to stir for 5 days under 1 atm of hydrogen. The mixture was passed through celite, and volatiles removed. The residue was chromatographed on silica gel (heptanes/DCM) to give 2.5 g (29%) of 2-amino-3-benzyl-5-phenylpyrazine.

Synthesis of 2-amino-3-phenylpropanenitrile hydrochloride

A round bottomed flask was charged with 65 g (0.624 mol) of sodium hydrogensulfite and 150 mL of water. A solution of 75 g (0.624 mol) of phenylacetaldehyde in 150 mL of THF was added dropwise. After stirring for 20 min, 37 mL of 14 M ammonium hydroxide was added in one portion, and the mixture heated to 60° C. for 60 min. After cooling to 0° C., the mix was diluted with 150 mL of water, and a solution of sodium cyanide (27.5 g, 0.560 mol) in 100 mL of water added dropwise keeping internal temperature below 10° C. Upon addition, the mixture was heated to 30° C. for 2 hrs and extracted with ether. After drying with sodium sulfate, all volatiles were evaporated, and the residue dissolved in 3.5 L of ether and treated with 400 mL of 3.3 M ethanolic HCl. The resulting precipitate was filtered and dried in vacuum to give 55 g (60%) of product.

Synthesis of 3-(furan-2-yl)-2-oxopropanoic acid

To a 100 mL flask, 3-(furan-2-yl)-2-oxopropanoate (940 mg) along with 23 mL cold 6N NaOH was added. The insoluble mixture was stirred in a 90° C. bath for 5 min until dissolved. Cold 1N HCl was added until solution was acidic (approx 120 mL). Solution was extracted 2×50 mL EtOAc. Combined organic layers were washed with 40 mL brine and dried with $Na_2SO_4$. Solution was evaporated to yield 540 mg brown solid. Solid was further purified by reversed-phase high-performance liquid chromatography (HPLC) ramping from 97% aqueous trifluoroacetic acid (TFA) to acetonitrile (ACN).

Synthesis of ethyl 3-(furan-2-yl)-2-oxopropanoate

To a 500 mL flask containing the mixture of isomers (E/Z)-ethyl 2-formamido-3-(furan-2-yl)acrylate (5.0 g), a chilled solution of 220 mL 1.4M (5%) HCl in 50/50 ethanol/water was added. After 5 hrs, the reaction was partitioned between 200 mL of EtOAc and 30 mL brine. The aqueous layer was extracted 2×50 mL EtOAc. Combined organic layers were washed with 1×50 mL water, and 1×50 mL brine and dried over $Na_2SO_4$. Organic layers were co-evaporated with 26 g celite and eluted over 80 g silica gold ramping from heptane to EtOAc. The appropriate combined fractions were evaporated to yield 2.1 g.

Synthesis of (E/Z)-ethyl 2-formamido-3-(furan-2-yl)acrylate

To a 500 mL flask, 50 mL diethyl ether, $Cu_2O$ (320 mg), and furyl aldehyde (5.2 mL) was added. The flasked was cooled in an ice bath, and ethyl 2-isocyanoacetate (5.3 mL) added. After 1.5 hrs, potassium tert-butoxide (5 g) was added to the reaction. After 4 hrs, the heterogeneous reaction was filtered. 60 mL 30% citric acid and 20 mL EtOAc was added and stirred for 10 min. Aqueous layer was extracted with 50 mL EtOAc. Combined organic layers were dried over anhydrous sodium sulfate. EtOAc layers were co-evaporated with 24 g celite and eluted over 80 g silica gold ramping from heptane to EtOAc. Yellow syrup was used without further purification.

Synthesis of 2-oxo-3-(thiophen-2-yl)propanoic acid

To a 250 mL flask, (E/Z)-5-(thiophen-2-ylmethylene) imidazolidine-2,4-dione (5.0 g) and 100 mL of cold 6N NaOH were added. The mixture was heated to 100° C. for 1 hr. Concentrated HCl was added to the cooled solution until acidic (pH=1). The mixture was extracted 8×50 mL diethylether. The combined ether layers were washed with 50 mL brine, dried over $Na_2SO_4$ and evaporated to yield 3.36 g solid. Sample was further purified by recrystallization with α,α,α-trifluorotoluene to yield 1.63 g.

Synthesis of (E/Z)-5-(thiophen-2-ylmethylene)imidazolidine-2,4-dione

To a 250 mL flask, hydantoin (9.8 g) and thiophene-2-carbaldehyde (10 g) were added. To the mixture was dripped piperidine (9.6 mL). The mixture was heated to 100° C. for 1 hr and then poured into 300 mL of 1N HCl. The solid was filtered, washed with water and dried in vacuo to yield 4.9 g solid.

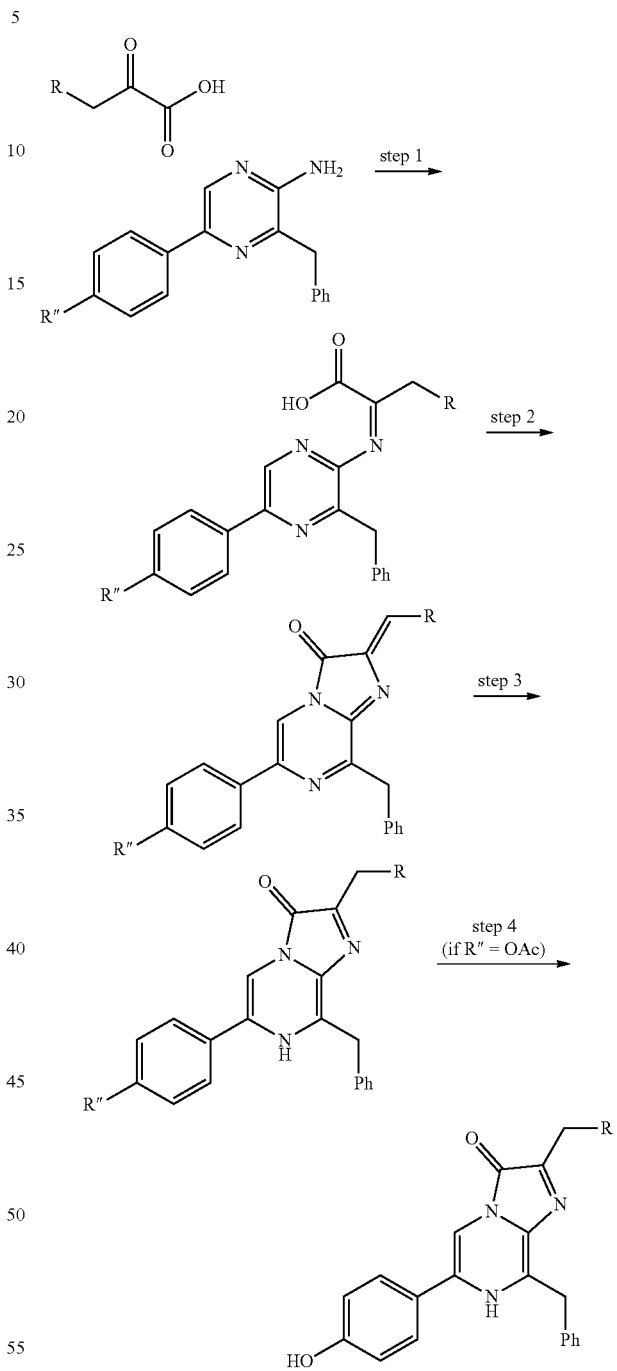

Steps 1—

To a microwave vial (10 mL), the appropriate phenylpyrazin-2-amine (100 mg), the appropriate pyruvic acid (2 Equivalents), DCM (1 mL), and 1,1,1-trifluoroethanol (1 mL) were heated with stirring for 30 min at 80° C. Reaction was co-adsorbed on 2 grams of celite, and solvents removed in vacuo. The celite was loaded on 24 g of spherical silica gel and eluted with a ramp of heptanes to ethylacetate. Appropriate fractions were combined and evaporated.

Step 2—

The material isolated in step 1 dissolved in THF (0.5 mL) was chilled in an ice bath. Acetic anhydride (25 µL), dimethylaminopyridine (8.5 mg), and triethylamine (25 µL) were added. After 2 hrs, the majority of THF was removed in vacuo. The product was precipitated with an aqueous solution of 30% citric acid (2 mL). The solid was washed with water (2 mL) and then dissolved in 3 mL DCM. The DCM was washed 1×2 mL water followed by 1×2 mL brine. The DCM layer was co-adsorbed on 2 grams of celite, and solvent removed in vacuo. The celite was loaded on 12 g of spherical silica gel and eluted with a ramp of heptanes to DCM. Appropriate fractions were combined and evaporated.

Step 3—

The material from step 2 dissolved in DCM (1 mL) was chilled in an ice bath. To the solution, methanol (0.5 mL) and sodium borohydride solution in diglyme (325 µL of 0.5 M) were added. After 2 hrs, acetic acid (10 µL) was added, and the solution quickly partitioned between an aqueous solution of 30% citric acid (1 mL) and DCM (2 mL). The DCM layer was co-adsorbed on 1 gram of celite, and solvent removed in vacuo. The celite was loaded on 4 g of spherical silica gel and eluted with a ramp of DCM to EtOAc. Appropriate fractions were combined and evaporated.

Step 4 (only if R″=OAc)—

The material in step 3 was dissolved in THF (200 µL) and chilled in an ice bath. 1 equivalent of 1.35 M potassium methoxide in THF was added to the solution. After 30 min, the reaction was partitioned between DCM (1 mL) and 30% citric acid (1 mL). The DCM layer was co-adsorbed on 0.5 g celite, and solvent removed in vacuo. The celite was loaded on 4 g of spherical silica gel and eluted with a ramp of DCM to EtOAc. Appropriate fractions were combined and evaporated.

Method D:

(the following compounds can be synthesized by method D: compounds PBI-3899, PBI-3900, PBI-3925, PBI-3933, PBI-3946)—In general, an aminopyrazine was condensed with 2 equivalents of a 2-oxoacid under an atmosphere of hydrogen in the presence of palladium catalyst. The alpha-amino acid produced was purified and subsequently activated for intramolecular condensation giving rise to the corresponding imidazopyrazinone.

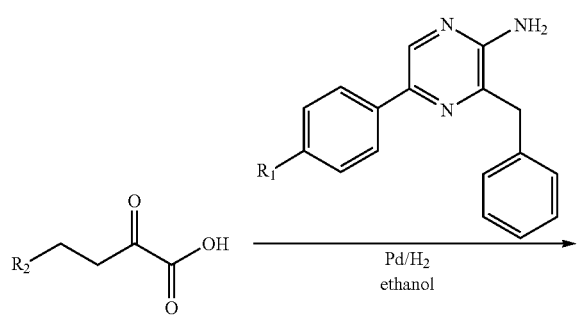

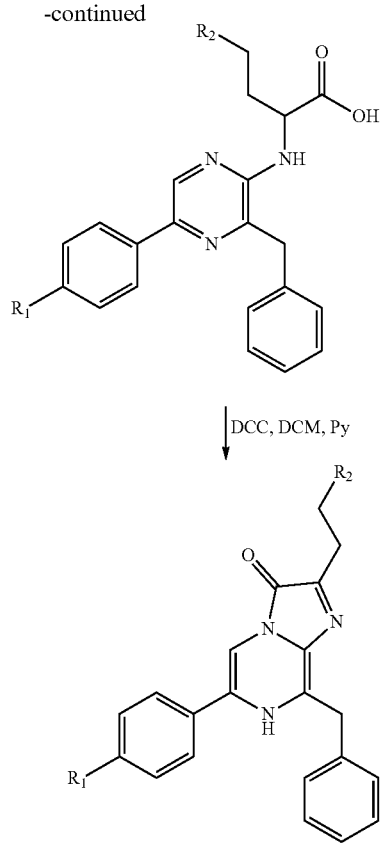

Example 5—Synthesis of 8-benzyl-6-(4-hydroxyphenyl)-2-propylimidazo[1,2-a]pyrazin-3(7H)-one 2-((3-benzyl-5-(4-hydroxyphenyl)pyrazin-2-yl)amino)pentanoic acid 4-(5-amino-6-benzylpyrazin-2-yl)phenol (100 mg, 0.36 mmol) was mixed with 2-Oxovaleric acid (84 mg, 0.72 mmol) in ethanol (20 mL). Pd/C (10% Palladium in active carbon, 40 mg) was added, and the reaction mixture heated to 65° C. Air was bubbled out by $N_2$ gas, and a hydrogen balloon applied to the reaction flask. The reaction was continuously stirred for 4 hrs. After cooling down, it was filtered, and the resulting solution purified by flash chromatography (eluting solvent: 50% EtOAc in heptanes) to give the product as a yellow powder (70 mg, 52%). $^1$H NMR (300 MHz, $CD_2Cl_2$, δ): 8.31 (s, 1H), 7.82 (d, 2H, J=9.0 Hz), 7.31 (m, 5H), 6.92 (d, 2H, J=9.0 Hz), 5.34 (s, 2H), 4.20 (m, 1H), 1.10 (m, 2H), 0.98 (m, 2H), 0.87 (t, 3H); MS (ESI) m/z 378.3 (M+1).

8-benzyl-6-(4-hydroxyphenyl)-2-propylimidazo[1,2-a]pyrazin-3(7H)-one 2-((3-benzyl-5-(4-hydroxyphenyl)pyrazin-2-yl)amino) pentanoic acid (49 mg, 0.13 mmol) was dissolved in DCM (10 mL). Pyridine (0.5 mL) was added followed by N,N′-Dicyclohexylcarbodiimide (54 mg, 0.26 mmol). The reaction mixture was slowly stirred at room temperature for 1 hr. The solvent was evaporated, and the residue purified by flash chromatography (eluting solvent: EtOAc to DCM to 10% methanol in DCM) to give the product as a yellow powder (40 mg, 86%). $^1$H NMR (300 MHz, CD$_3$OD, δ): 7.35 (m, 8H), 6.88 (d, J=9.0 Hz, 2H), 4.40 (s, 2H), 2.81 (t, J=7.5 Hz, 2H), 1.81 (m, 2H), 1.02 (t, J=7.5 Hz, 3H); MS (ESI) m/z 359.0.

Example 6—Synthesis of 8-benzyl-2-butyl-6-(4-hydroxyphenyl)imidazo[1,2-a]pyrazin-3(7H)-one 2-((3-benzyl-5-(4-hydroxyphenyl)pyrazin-2-yl)-amino)hexanoic acid 4-(5-amino-6-benzylpyrazin-2-yl)phenol (200 mg, 0.72 mmol) was mixed with 2-Ketohexanoic acid sodium salt (220 mg, 1.44 mmol) in ethanol (20 mL). Pd/C (10% Palladium in active carbon, 100 mg) was added with a few drops of acetic acid, and the reaction mixture heated to 65° C. Air was bubbled out by N$_2$ gas, and a hydrogen balloon applied to the reaction flask. The reaction was continuously stirred for 4 hrs. After cooling down, it was filtered and the resulting solution was purified by flash chromatography (eluting solvent: 50% EtOAc in heptanes) to give the product as a yellow powder (130 mg, 46%). MS (ESI): m/z 392.2 (M+1).

8-benzyl-2-butyl-6-(4-hydroxyphenyl)imidazo[1,2-a]pyrazin-3(7H)-one 2-((3-benzyl-5-(4-hydroxyphenyl)pyrazin-2-yl)amino)hexanoic acid (130 mg, 0.33 mmol) was dissolved in DCM (10 mL). Pyridine (0.5 mL) was added followed by N,N'-Dicyclohexylcarbodiimide (137 mg, 0.67 mmol). The reaction mixture was slowly stirred at room temperature for 1 hr. The solvent was evaporated, and the residue purified by flash chromatography (eluting solvent: EtOAc to DCM to 10% methanol in DCM) to give the product as a yellow powder (110 mg, 89%). $^1$H NMR (300 MHz, CD$_3$OD, δ): 7.30 (m, 8H), 6.88 (d, 2H), 4.40 (s, 2H), 2.84 (t, 2H), 1.77 (m, 2H), 1.51 (m, 2H), 0.89 (m, 3H); MS (ESI) m/z 374.3 (M+1).

Example 7—Synthesis of 8-benzyl-2-ethyl-6-phenylimidazo[1,2-a]pyrazin-3(7H)-one (PBI-3925)

2-((3-benzyl-5-phenylpyrazin-2-yl)amino)butanoic acid 3-benzyl-5-phenylpyrazin-2-amine (200 mg, 0.77 mmol) was mixed with 2-Oxobutyric acid (157 mg, 1.54 mmol) in ethanol (20 mL). Pd/C (10% Palladium in active carbon, 100 mg) was added, and the reaction mixture heated to 65° C. Air was bubbled out by N$_2$ gas, and a hydrogen balloon applied to the reaction flask. The reaction was continuously stirred for 4 hrs. After cooling down, it was filtered, and the resulting solution purified by flash chromatography (eluting solvent: 50% EtOAc in heptanes) to give the product as a yellow powder (90 mg, 34%). $^1$H NMR (300 MHz, CD$_2$Cl$_2$, δ): 7.72 (s, 1H), 7.32-7.48 (m, 10H), 4.46 (s, 2H), 4.20 (m, 2H), 2.25 (q, 2H), 0.99 (t, 3H); MS (ESI): m/z 348.3 (M+1).

2-((3-benzyl-5-phenylpyrazin-2-yl)amino)butanoic acid was dissolved in DCM (10 mL). Pyridine (0.5 mL) was added followed by N,N'-Dicyclohexylcarbodiimide (137 mg, 0.67 mmol). The reaction mixture was slowly stirred at room temperature for 1 hr. The solvent was evaporated, and the residue purified by flash chromatography (eluting solvent: EtOAc to DCM to 10% methanol in DCM) to give the product as a yellow powder (110 mg, 89%). $^1$H NMR (300 MHz, CD$_3$OD, δ): 7.26 (m, 3H), 6.84-7.07 (m, 8H), 4.03 (s, 2H), 2.47 (q, J=9.0 Hz, 2H), 0.96 (t, J=9.0 Hz, 3H); MS (ESI): m/z 330.2 (M+1).

Example 8—Synthesis of 8-benzyl-6-phenyl-2-(3,3,3-trifluoropropyl)imidazo[1,2-a]pyrazin-3(7H)-one

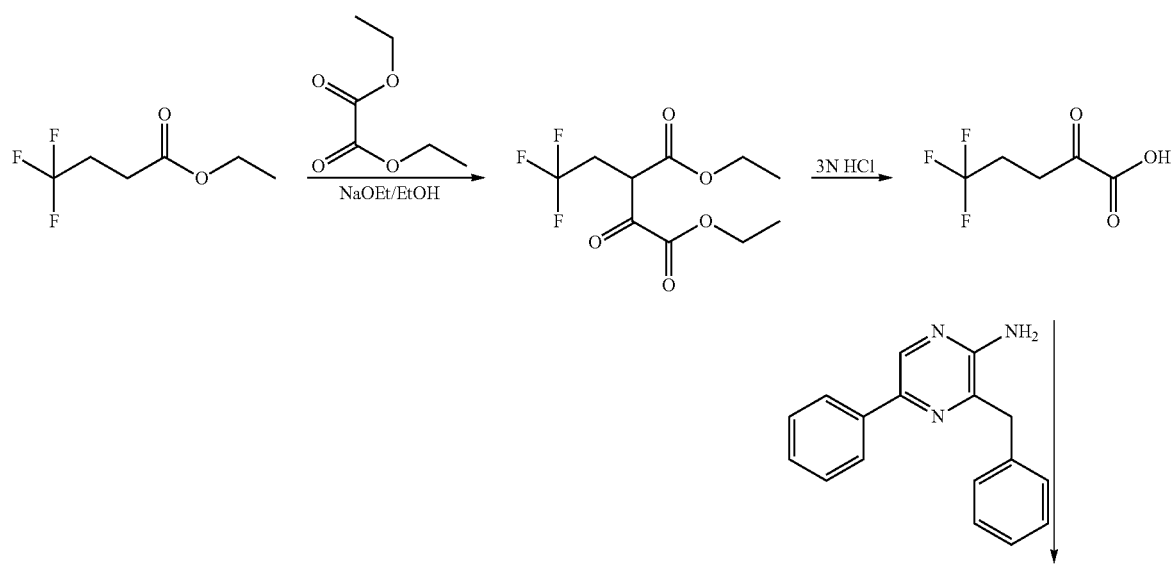

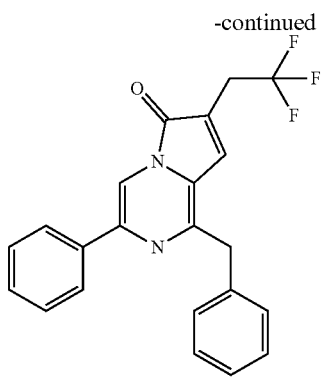 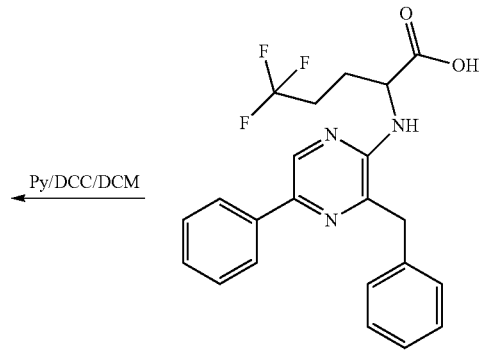

5,5,5-trifluoro-2-oxopentanoic acid

Ethyl 4,4,4-trifluorobutyrate (1 g, 5.88 mmol) and diethyl oxalate (3.87 g, 26.5 mmol) was dissolved in ethanol. Sodium ethoxide (21% in ethanol, 2.09 g) was added to the solution, and the reaction mixture stirred for 0.5 hrs. Solvent was distilled, and the residue extracted with EtOAc/water. The organic layers were collected and dried over sodium sulfate. After filtration, solvent was removed to give a clear liquid. MS (ESI): m/z 269.1 (M−1). The liquid was then dissolved in 3N HCl (20 mL), and the reaction mixture refluxed for 4 hrs. After cooling down, the reaction mixture was extracted with EtOAc. The organic layers were collected and dried over sodium sulfate. After filtration, solvent was removed, and the residue used directly in the next step. MS (ESI): m/z 169.7 (M−1).

5,5,5-trifluoro-2-((3-benzyl-5-phenylpyrazin-2-yl) amino)butanoic acid 3-benzyl-5-phenylpyrazin-2-amine (240 mg, 0.92 mmol) was mixed with 5,5,5-trifluoro-2-oxopentanoic acid (150 mg, 0.88 mmol) in ethanol (20 mL). Pd/C (10% Palladium in active carbon, 100 mg) was added, and the reaction mixture heated to 65° C. Air was bubbled out by $N_2$ gas, and a hydrogen balloon applied to the reaction flask. The reaction was continuously stirred for 4 hrs. After cooling down, it was filtered, and the resulting solution purified by flash chromatography (eluting solvent: 50% EtOAc in heptanes) to give the product as a yellow powder (200 mg, 54%). $^1$H NMR (300 MHz, $CD_2Cl_2$, δ): 11.45 (s, 1H), 10.20 (s, 1H), 7.94 (s, 1H), 7.34 (m, 10H), 5.34 (s, 2H), 3.96-4.23 (m, 2H), 3.02-3.28 (m, 2H); FNMR: −76.3; MS (ESI): m/z 416.1 (M+1).

Coelenterazine ($R_1$=H, $R_2$=—$CH_2CH_2CF_3$)

5,5,5-trifluoro-2-((3-benzyl-5-phenylpyrazin-2-yl)amino) butanoic acid (100 mg, 0.24 mmol) was dissolved in DCM (10 mL). Pyridine (0.5 mL) was added followed by N,N'-Dicyclohexylcarbodiimide (100 mg, 0.48 mmol). The reaction mixture was slowly stirred at room temperature for 1 hr. The solvent was evaporated, and the residue purified by flash chromatography (eluting solvent: EtOAc to DCM to 10% methanol in DCM) to give the product as a yellow powder (80 mg, 87%). $^1$H NMR (300 MHz, $CD_2Cl_2$, δ): 7.36 (m, 11H), 3.43 (s, 2H), 1.60-1.92 (m, 4H); $^{19}$FNMR: 67.4 (t, J=18 Hz); MS (ESI): m/z 398.2 (M+1).

Example 9—Synthesis of 8-benzyl-2-(furan-2-ylmethyl)-6-phenylimidazo[1,2-a]pyrazin-3(7H)-one (PBI-3939)

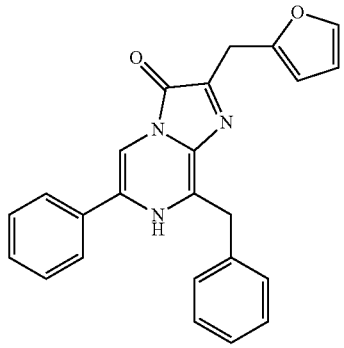

PBI-3939

8-benzyl-2-(furan-2-ylmethyl)-6-phenylimidazo[1,2-a]pyrazin-3(7H)-one

Synthesized from method C using 3-(furan-2-yl)-2-oxo-propanoic acid and 3-benzyl-5-phenylpyrazin-2-amine as starting materials. $^1$H NMR (300 MHz, dmso) δ 8.88 (s, 1H), 8.02 (d, J=7.9, 2H), 7.61-7.38 (m, 6H), 7.37-7.14 (m, 3H), 6.38 (s, 1H), 6.26 (d, J=3.2, 1H), 4.64 (s, 3H), 4.40 (s, 3H); exact mass calculated for $C_{24}H_{20}N_3O_2^+$ m/z+382.16. found m/z+382.

Example 10—Synthesis of 8-benzyl-6-phenyl-2-(thiophen-2-ylmethyl)imidazo[1,2-a]pyrazin-3(7H)-one (PBI-3889)

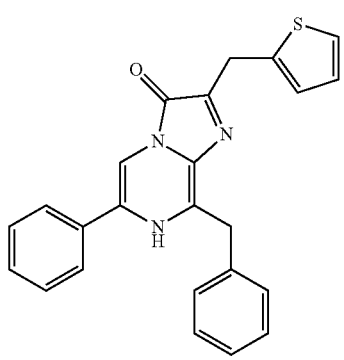

PBI-3889

8-benzyl-6-phenyl-2-(thiophen-2-ylmethyl)imidazo[1,2-a]pyrazin-3(7H)-one

Synthesized from method C using 2-oxo-3-(thiophen-2-yl)propanoic acid and 3-benzyl-5-phenylpyrazin-2-amine as starting materials. $^1$H NMR (300 MHz, dmso) δ 8.85 (s, 1H), 7.99 (d, J=6.8, 2H), 7.63-7.02 (m, 10H), 6.94 (dd, J=3.5, 5.1, 1H), 4.62 (s, 2H), 4.58 (s, 2H), 2.69 (contaminate); exact mass calculated for $C_{24}H_{20}N_3OS^+$ m/z+398.13. found m/z+ 398.

Example 11—Synthesis of 8-cyclopropyl-2-(4-hydroxybenzyl)-6-phenylimidazo[1,2-a]pyrazin-3(7H)-one (PBI-3897)

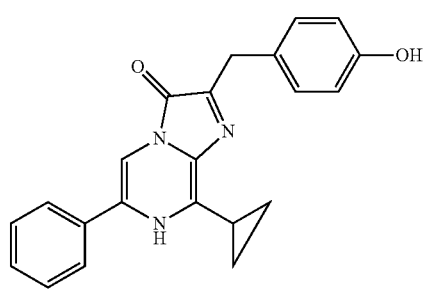

PBI-3897

8-cyclopropyl-2-(4-hydroxybenzyl)-6-phenylimidazo[1,2-a]pyrazin-3(7H)-one

Synthesized using method A with 3-cyclopropyl-5-phenylpyrazin-2-amine and 3-(4-hydroxyphenyl)-2-oxopropanoic acid as starting materials. Exact mass calculated for $C_{22}H_{18}N_3O_2^-$ m/z-356.14. found m/z-356.

Example 12—Synthesis of 8-benzyl-2-methyl-6-phenylimidazo[1,2-a]pyrazin-3(7H)-one (PBI-3932)

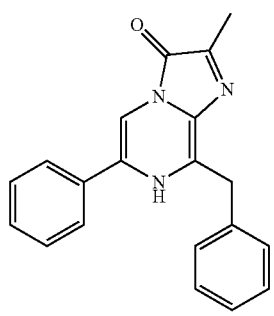

PBI-3932

8-benzyl-2-methyl-6-phenylimidazo[1,2-a]pyrazin-3(7H)-one

Synthesized using method B with 1,1-dimethoxypropan-2-one and 3-benzyl-5-phenylpyrazin-2-amine as starting materials. Exact mass calculated for $C_{20}H_{18}N_3O^+$ m/z+316.14. found m/z+316.

Example 13—Synthesis of 2-(4-hydroxybenzyl)-8-methyl-6-phenylimidazo[1,2-a]pyrazin-3(7H)-one (PBI-3896)

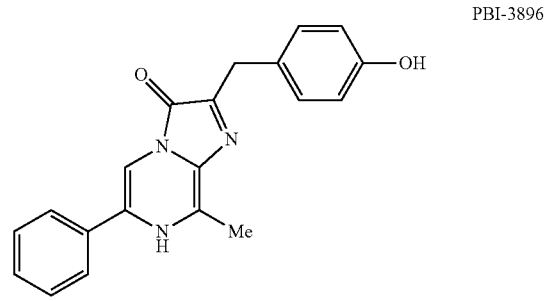 [SMILES: Cc1[nH]c(-c2ccccc2)cn2c(=O)c(Cc3ccc(O)cc3)nc1-2]

PBI-3896

2-(4-hydroxybenzyl)-8-methyl-6-phenylimidazo[1,2-a]pyrazin-3(7H)-one

Synthesized using method A with 3-methyl-5-phenylpyrazin-2-amine and 3-(4-hydroxyphenyl)-2-oxopropanoic acid as starting materials. $^1$H NMR (300 MHz, dmso) δ 8.84 (s, 1H), 8.00 (d, J=7.6, 2H), 7.47 (dd, J=8.6, 16.2, 3H), 7.17 (d, J=7.3, 2H), 6.69 (d, J=8.4, 2H), 6.26 (s, 4H), 4.17 (s, 2H), 2.86 (s, 3H), 2.48 (s, 1H).

Example 14—Synthesis of 8-benzyl-2-(4-hydroxybenzyl)-6-phenylimidazo[1,2-a]pyrazin-3(7H)-one (PBI-3840)

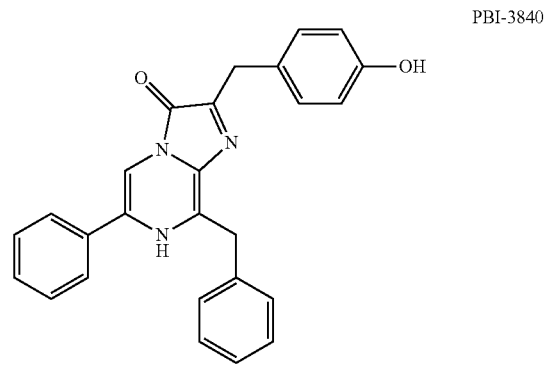 [SMILES: O=c1c(Cc2ccc(O)cc2)nc2c(Cc3ccccc3)[nH]c(-c3ccccc3)cn1-2]

PBI-3840

8-benzyl-2-(4-hydroxybenzyl)-6-phenylimidazo[1,2-a]pyrazin-3(7H)-one

Synthesized using method A with 3-(4-hydroxyphenyl)-2-oxopropanoic acid and 3-benzyl-5-phenylpyrazin-2-amine as starting materials. Exact mass calculated for $C_{26}H_{22}N_3O_2^+$ m/z+408.17. found m/z+408.

Example 15—Synthesis of Protected Coelenterazine (Stabilized) (PBI-4377)

To a mixture of PBI-3939, potassium carbonate (1.1 equiv) and potassium iodide (1.1 equiv) in dimethylformamide (DMF), under an argon atmosphere, was added one equivalent of chloromethyl pivalate at room temperature.

Reaction progress was monitored by thin layer chromatography, and upon completion, the reaction mixture was cooled in an ice bath for several minutes before addition of a volume of water equal to the reaction volume. The resulting mixture was extracted with a suitable organic solvent (e.g., EtOAc), and the extract was concentrated to give the crude product. The material was further purified by chromatography over silica gel.

Example 16—Synthesis of 8-benzyl-2-((1-methyl-1H-imidazol-2-yl)methyl)-6-phenylimidazo[1,2-a]pyrazin-3(7H)-one (PBI-4525), 8-benzyl-6-(4-hydroxyphenyl)-2-((1-methyl-1H-imidazol-2-yl)methyl)-6-phenylimidazo[1,2-a]pyrazin-3(7H)-one (PBI-4540) and 2-((1H-imidazol-2-yl)methyl)-8-benzyl-6-phenylimidazo[1,2-a]pyrazin-3(7H)-one (PBI-4541)

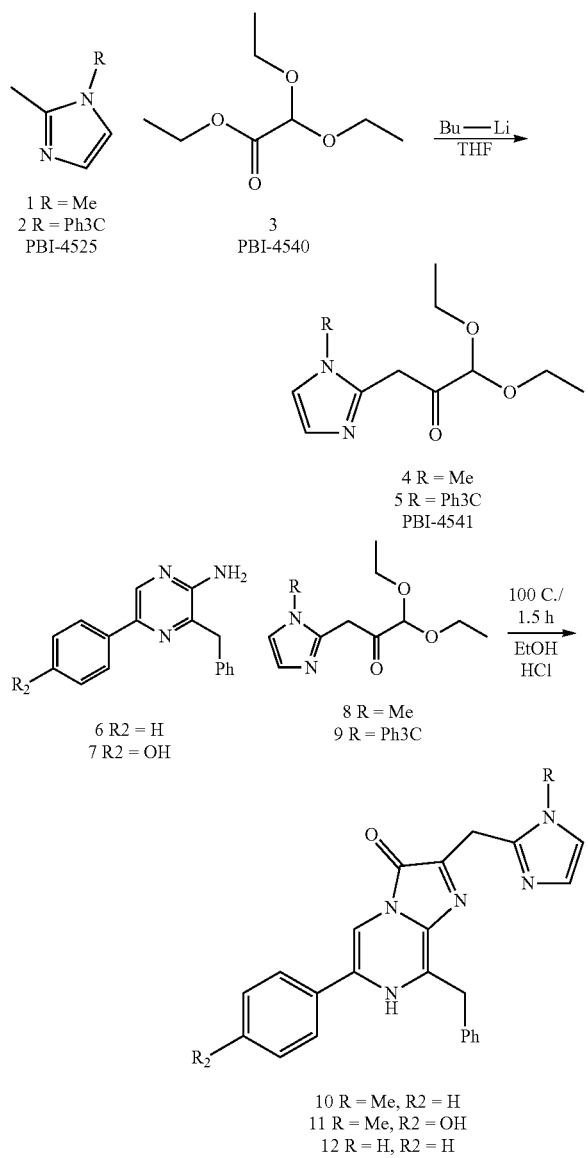

To a flask containing 10 mmol of 2-methyl imidazole derivative 1 or 2 under an argon atmosphere, 20 mL of dry THF was added, and the solution was cooled in a dry ice/acetone bath to approximately −78° C. To the cold mixture, 9.3 mmol of a solution of n-butyllithium (2.46 M in Hexanes) was added dropwise over several minutes. The resulting solution was stirred at approximately −78° C. for 30 min, and 6.7 mmol of compound 3 was added via syringe. The reaction mixture was stirred for 3 hrs and quenched with the addition of 20 mL saturated ammonium chloride solution and 20 mL of saturated sodium bicarbonate solution. The cold bath was removed, and after warming to room temperature, the mixture was extracted with 3×100 mL of EtOAc. The combined extracts were dried (MgSO₄), concentrated in vacuo, and the crude compounds 4 or 5 were purified by column chromatography using silica gel (EtOAc/Heptane).

A microwave vial was charged with 100 mg (1 eq) of compound 6 or 7 and 2 equivalents of compound 8 or 9. To the mixture, 4.5 mL of ethanol and 0.25 mL of concentrated HCl was added. The reaction mixture was heated in a microwave at 100° C. for 1.5 hr. The resulting mixture was added to 50 mL of EtOAc and washed sequentially with 20 mL of saturated sodium bicarbonate solution and 20 mL of brine. The organic phase was concentrated in vacuo, and the residue purified by column chromatography using silica gel (methanol/dichloromethane) to give compounds 10-12.

Example 17—Stability and Auto-Luminescence Characterization of Novel Coelenterazines The stability and auto-luminescence characterization of the novel coelenterazines PBI-3939, PBI-3889, PBI-3945, PBI-4002, or PBI-3896 were determined Higher stability and less auto-luminescence is an attractive technical feature in a substrate/reagent.

To determine stability, 20 µM of novel coelenterazines PBI-3939, PBI-3889, PBI-3945, PBI-4002, or PBI-3896, 30 µM native coelenterazine, or 22 µM of known coelenterazine-h or known coelenterazine-hh, were placed in a reporter reagent buffer containing 50 mM CDTA, 150 mM KCl, 50 mM DTT, 35 mM thiourea, 1% TERGITOL® NP-9 (v/v), and 0.1% MAZU® DF 204. Replicate samples were incubated at room temperature (i.e., 22-24° C.) for various lengths of time and then transferred to −70° C. After all the samples were collected and frozen, they were thawed and mixed with 10 µL of bacterial cell lysate containing the OgLuc variant IV in 40 µL of DMEM without phenol red+0.1% PRIONEX®. The luminescence of the sample was read at 5 min after IV addition.

"$T_{90}$" indicates the amount of time for the luminescent signal to decay by 10% (i.e., loss in activity by 10%) at ambient temperature, i.e., 22° C. The rate of decay of the luminescent signal ("$T_{90}$") was determined from the slope of the linear fit of the data plotted as ln RLU vs. time, which was calculated from the following equation: $t=\ln(A/A_0)\div(-k)$, where A=intensity at time t, $A_0$=intensity at time 0, and k=the rate of decay. As shown in Table 1, the $T_{90}$ values for known coelenterazines-h and -hh, novel coelenterazines PBI-3939, PBI-3889, PBI-3945, PBI-4002, and PBI-3896 were higher than for native coelenterazine, indicating that these coelenterazines were more stable compounds than native coelenterazine.

Figure 2:
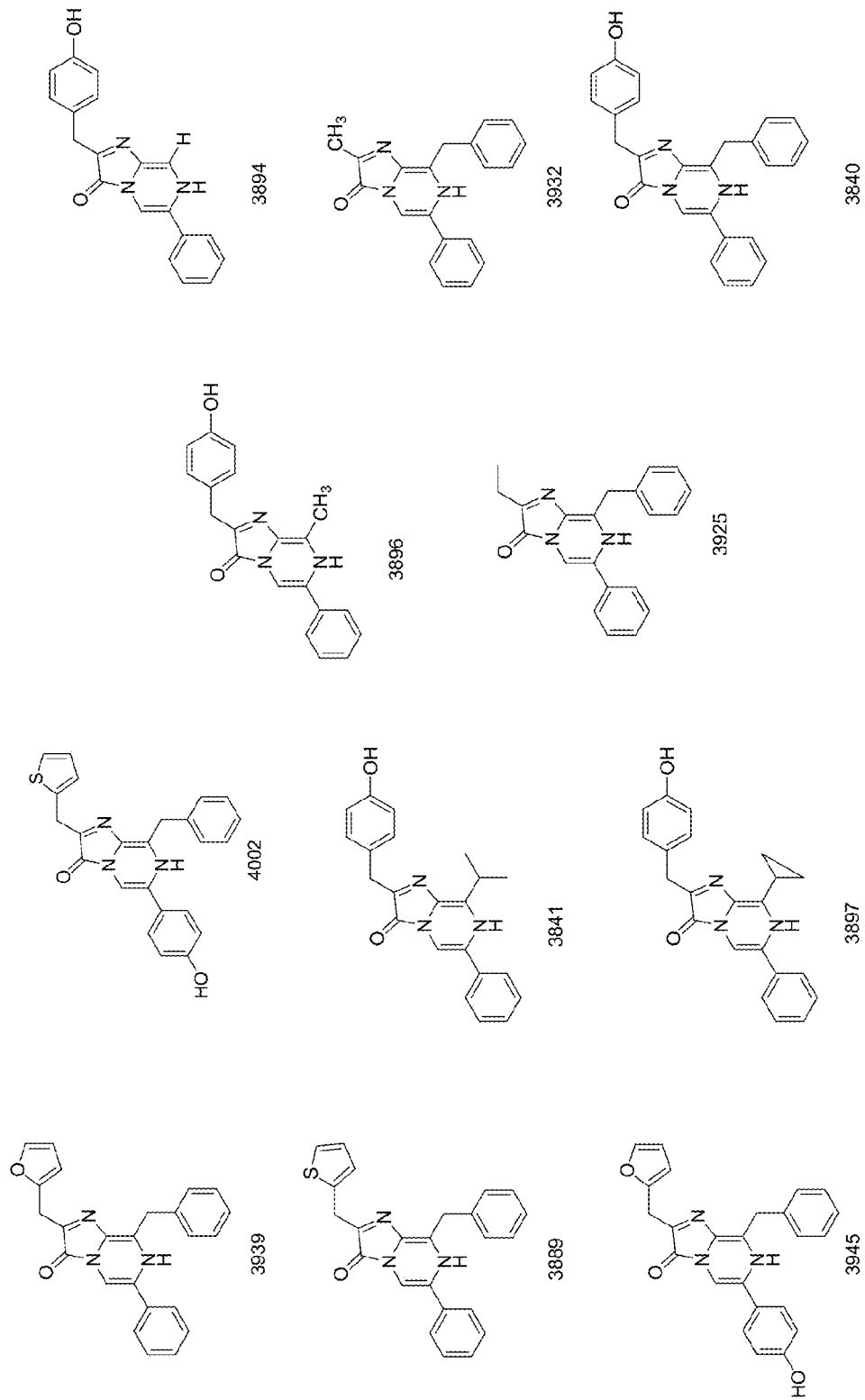
FIG. 2 shows the chemical structure of novel coelenterazines PBI-3939, PBI-3889, PBI-3945, PBI-4002, PBI-3841, PBI-3897, PBI-3896, PBI-3925, PBI-3894, PBI-3932, and PBI-3840.

To determine the auto-luminescence characterization, HEK293 cells were grown overnight at 15,000 cells per well in DMEM+10% FBS+pyruvate. Media was removed and replaced with 20 µM each of the novel coelenterazines shown in FIG. 2, i.e., PBI-3939, PBI-3889, PBI-3945, PBI-4002, PBI-3841, PBI-3897, PBI-3896, PBI-3925, PBI- 3894, PBI-3932, and PBI-3840, native coelenterazine and known coelenterazines, coelenterazine-h and coelenterazine-hh, diluted into $CO_2$ independent media plus 10% FBS. Luminescence was measured shortly after substrate addition on the GLOMAX® Luminometer (1 sec/well). Background luminescence was 154±15 RLU. Table 1 shows the autoluminescence characterization normalized to native coelenterazine ("Autolum (norm to coel)"). While coelenterazine-h had more auto-luminescence than native coelenterazine, all of the other coelenterazines tested had less auto-luminescence.

TABLE 1

Stability Experiments and Autoluminescence Characterization of IV with Various Coelenterazines.

| Substrate ID | Stability (pH 8) ($T_{90}$ in hrs) | Autolum (norm to coel) |
| --- | --- | --- |
| Coel | 1.7 | 1 |
| Coel h | 2.1 | 1.2 |
| Coel hh | 2.0 | 0.3 |
| 3939 | 4.1 | 0.2 |
| 3889 | 2.9 | 0.2 |
| 3945 | 3.3 | 0.5 |
| 4002 | 3.5 | 0.6 |
| 3841 |  | 0.1 |
| 3897 |  | 0.1 |
| 3896 | 2.8 | 0.1 |
| 3894 |  | 0.2 |
| 3932 |  | 0.1 |
| 3840 |  | 0.2 |
| 3925 |  | 0.2 |

Example 18—Toxicity of Novel Coelenterazines

The toxicity of the novel coelenterazines were investigated in HEK293 cells. HEK293 cells were grown overnight at 15,000/well in DMEM+10% FBS+pyruvate. The media was removed and replaced with the novel coelenterazine compounds (or DMSO control) diluted into $CO_2$ independent media plus 10% FBS. Cell viability was measured 24 hrs after compound addition using CELLTITER-GLO® assay reagent (Promega Corp.) according to the manufacturer's instructions, and luminescence was measured on the GLOMAX® Luminometer (1 sec/well). Table 2 shows the toxicity of the native coelenterazine, known coelenterazine-h and coelenterazine-hh, and the novel coelenterazines PBI-3939, PBI-3889, PBI-3841, PBI-3897, PBI-3945, PBI-4002, and PBI-3840 in HEK293 cells. With the exception of PBI-3840, the novel coelenterazines had at least the same toxicity as coelenterazine-hh. Some of the novel coelenterazines had the same toxicity as native coelenterazine and coelenterazine-h.

TABLE 2

Toxicity of Various Coelenterazines in HEK293 Cells Based on CELLTITER-GLO®

| Substrate | Viability (normalized to vehicle (DMSO) control) (%) |
| --- | --- |
| Native coelenterazine | 100 |
| Coelenterazine h | 100 |
| Coelenterazine hh | 87 |
| PBI-3939 | 89 |
| PBI-3889 | 90 |
| PBI-3841 | 100 |
| PBI-3897 | 100 |

TABLE 2-continued

Toxicity of Various Coelenterazines in HEK293 Cells Based on CELLTITER-GLO®

| Substrate | Viability (normalized to vehicle (DMSO) control) (%) |
| --- | --- |
| PBI-3945 | 100 |
| PBI-4002 | 100 |
| PBI-3840 | 60 |

Example 19—Km of PBI-3939

Figure 3:
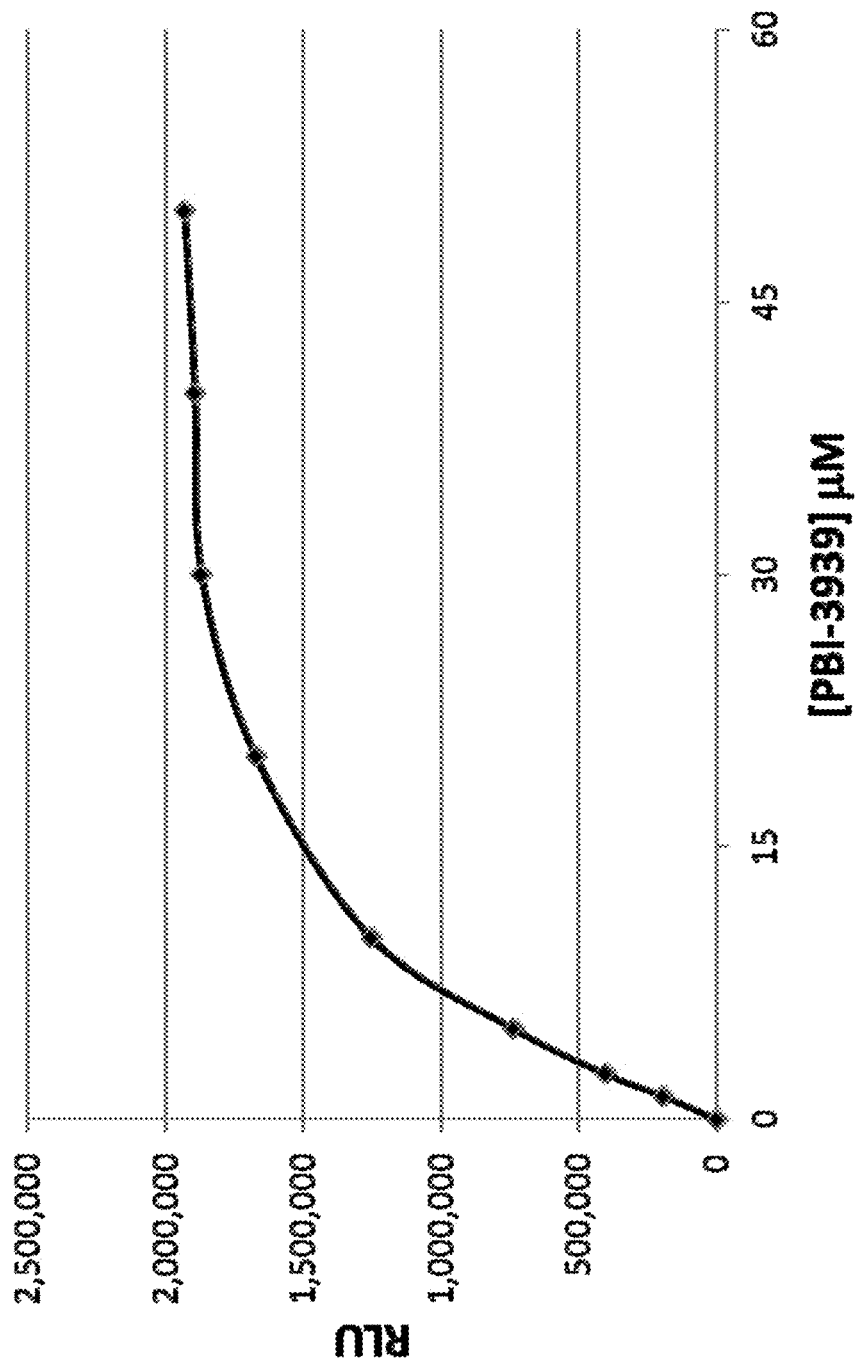
FIG. 3 shows the Km determination of PBI-3939.

To determine the Km of PBI-3939, the OgLuc variant L27V (described in Example 26) was purified via HALOTAG® fusion using the HALOTAG® Protein Purification System according to the manufacturer's instructions and diluted in DMEM without Phenol Red and 0.1% PRIONEX®. 50 µL assay buffer (100 mM MES pH 6, 35 mM Thiourea, 0.5% TERGITOL® NP-9 (v/v), 1 mM CDTA, 2 mM DTT and 150 mM KCl) with varying amounts of PBI-3939 was added to 50 µL diluted enzyme (approximately 20 µM final enzyme concentration), and luminescence measured at 3 min at 22° C. As the data in FIG. 3 demonstrates, the Km of PBI-3939 is approximately 10 µM.

Example 20—Characterization of Compounds PBI-4525, PBI-4540 and PBI-4541

Compounds PBI-4525, PBI-4540 and PBI-4541 were screened for their ability to detect luminescence. For analysis, 20 µM of each compound was added to assay buffer (100 mM MES pH 6, 35 mM Thiourea, 0.5% TERGITOL® NP-9 (v/v), 1 mM CDTA, 2 mM DTT and 150 mM KCl) which was adjusted to pH 7 with 100 mM HEPES pH 7 to create an assay reagent. The assay reagent was then mixed with 36 µM purified L27V02 enzyme (described in Example 25B), in DMEM without Phenol Red and 0.1% PRIONEX®. As a control, assay buffer with 20 µM PBI-3939 or PBI-4528 was used. Luminescence was measured as previously described 3 min after the assay reagent was added to the enzyme mixture. Table 3 demonstrates that compounds PBI-4525, PBI-4540 and PBI-4541 can be used to detect luminescence from a coelenterazine-utilizing luciferase.

TABLE 3

| cmpd | RLU | +/− |
| --- | --- | --- |
| 4525 | 20,655 | 1,006 |
| 4528 | 202,080 | 5,688 |
| 3939 | 9,808,880 | 307,565 |
| 4540 | 909 | 7 |
| 4541 | 5,676 | 80 |

Example 21—OgLuc Pattern Sequence

Enzyme families, including different classes of luciferases, can be recognized by having common three-dimensional structures and defined catalytic activity. Because enzyme families share evolutionary histories with other enzyme families, they will also exhibit similarities in their three-dimensional structures. Through various means of structural and functional analysis, the inventors have determined that OgLuc, as a representative of decapod luciferases, has a strikingly similar three-dimensional structure to Fatty Acid Binding Proteins (FABPs), indicating commonality of evolutionary history. Thus, decapod luciferase may be defined as having a characteristic three-dimensional structure similar to FABPs and utilizing coelenterazine as a substrate to catalyze the emission of luminescence. Other luciferases, e.g., firefly luciferase, Renilla luciferase, bacterial luciferase, and so forth, have clearly distinct three-dimensional structures, indicating that they belong to different enzyme families and do not share evolutionary histories. Dinoflagellate luciferase has a three-dimensional structure exhibiting some similarities to FABPs, suggesting a shared evolutionary history, but does not utilize coelenterazine as a substrate, and thus does not belong to the same enzyme family as decapod luciferases.

Because amino acid sequences are not as well conserved as three-dimensional structures, defining enzyme families based only on sequence comparisons can be difficult. For example, even though FABPs all have a characteristic barrel-shaped three-dimensional shape, comparisons of their amino acid sequences often reveal very low levels of sequence identity. Nonetheless, sequence identity can be used to demonstrate commonality of three-dimensional structures. Two proteins will have analogous three-dimensional structures if their amino acid sequences can be aligned to reveal >30% sequence identity, preferably >40% sequence identity, and most preferably >50% sequence identity (Chothia and Lesk, EMBO J. 5(4):823-826 (1986); Tramontano, Genomics, 4:402-405 (2003)). Thus, a protein is a decapod luciferase if, upon alignment of its amino acid sequence with the sequence of OgLuc, the sequence identity is >30%, preferably >40%, and most preferably >50%, and the protein can utilize coelenterazine as a substrate to catalyze the emission of luminescence.

Because of structural constraints necessary to sustain the characteristic three-dimensional structure of an enzyme family, some portions of the amino acid sequences in an enzyme family exhibit greater amounts of conservation (i.e., a greater level of sequence identity). Thus, these conserved regions can serve as further evidence of a common three-dimensional structure shared between two proteins. A conserved sequence pattern, also called a signature, motif, or fingerprint, can be generated by manual or computational methods that are known in the art. Patterns can be found in public databases such as PROSITE (http://expasy.org/prosite; Sigrist et al., Nucleic Acids Res. 38(suppl 1):D161-D166 (2010)).

For example, a pattern of conserved amino acids can be found upon examination of a large number of known FABPs. PROSITE (Release 20.67, of 5 Oct. 2010) contains an FABP pattern (accession number PS00214, created April-1990, data updated April-2006). This FABP pattern spans 18 amino acid positions and is defined as:

(VI)
(SEQ ID NO: 329)
8 GSAIVK]-{FE}-[FYW]-x-[LIVMF]-x-x-{K}-x-[NHG]-

[FY]-[DE]-x-[LIVMFY]-[LIVM]-{N}-{G}-[LIVMAKR], where:
the standard IUPAC one-letter codes for the amino acids are used.
the symbol 'x' is used for a position where any amino acid is accepted.
alternative amino acids at a site are indicated by listing the amino acids between square parentheses '[ ]' (for example: [ALT] represents the possibility of an Ala, Leu, or Thr at the position).

the absence of particular amino acids at a site is indicated by curly brackets '{ }' (for example: {AM} represents any amino acid at a position except Ala and Met).
each sequence position (or element in the pattern) is separated from its neighbor by '-'.
each sequence position is referred to as a "pattern position", for example the [GSAIVK] would be considered pattern position 1 of Formula (VI), {FE} is considered pattern position 2 of Formula (VI), etc.

Although a conserved sequence pattern results from a common underlying three-dimensional structure, some changes to the sequence pattern may be allowed without disruption to the three-dimensional structure. For example, for some members of the FABP family, differences are found at four sites in the PROSITE pattern. These additional members of the FABP family include five proteins listed in PROSITE as false negative hits, i.e., FABP protein family members not picked up by the FABP pattern (UniProt database accession numbers FBP12_HUMAN, FABP1_FASGI, FABP2_FASHE, FABPL_SCHBI, RET5_BOVIN) and one protein known to have an FABP fold (Protein Data Bank accession number 2A02). Although OgLuc shares a closely similar three-dimensional structure with FABPs, the sequence patterns of the native and variant amino acid sequences also differ slightly, having differences at 5 positions from the PROSITE pattern. In various embodiments, the pattern in OgLuc begins at a position corresponding to position 8 of SEQ ID NO: 1. An amino acid substitution, deletion, or insertion the sequence pattern is counted as a difference.

Combining the sequence information from these additional FABPs and the OgLuc variants, an improved sequence pattern can be derived:

(VII)
(SEQ ID NO: 330)
[GSAIVK]-{FE}-[FYW]-x-[LIVMFSYQ]-x-x-{K}-x-[NHGK]- x-[DE]-x-[LIVMFY]-[LIVMWF]-x-{G}-[LIVMAKRG].

The sequence information used to derive this pattern is shown in Table 4. Column 1 identifies the pattern position (listed N- to C-terminus; pattern length is 18 amino acids), and column 6 identifies the corresponding sequence position in OgLuc (numbering according to SEQ ID NO: 1). Column 2 shows the PROSITE FABP pattern (Formula (VI)) element for each pattern position. Column 3 lists amino acids present in six FABP family members that are not represented by the PROSITE FABP pattern. Column 4 lists amino acids present in OgLuc (SEQ ID NO: 1) or OgLuc variants that are not represented by the PROSITE pattern. Column 5 lists the improved pattern ("OgLuc pattern") (Formula (VII)) created by merging pattern information from columns 2, 3, and 4. Column 7 lists the amino acids in OgLuc (SEQ ID NO: 1) corresponding to the PROSITE FABP pattern positions. Column 8 lists the amino acids found in dinoflagellate luciferase sequences (8 different species) at positions corresponding to the improved pattern (GenBank accession numbers 2021262A, AAA68491, AAC36472, AAV35379, AAV35380, AAL40676, AAL40677, AAV35378, AAV35377, AAV35381, and Protein Data Bank accession number 1VPR).

The improved pattern (Formula (VII)) serves as an indication (i.e., a fingerprint) of the three-dimensional protein structure shared between FABPs and OgLuc. However, strict agreement with this pattern is not needed to indicate commonality of the three-dimensional structure. From the examples given here, a common three-dimensional structure may exist even with as many as 5 changes in the pattern. Also, for example, although the dinoflagellate luciferase has a similar three-dimensional structure to FABPs and OgLuc, it has 4 differences from the improved pattern.

Thus, although a protein may be recognized as being a decapod luciferase based on sequence similarity and utilization of coelenterazine for luminescence, it can be further recognized by also having the improved sequence pattern. Specifically, a protein is a decapod luciferase if, upon alignment of its amino acid sequence with SEQ ID NO: 1 or variants thereof, the sequence identity is >30%, preferably >40%, and most preferably >50%, and the protein can utilize coelenterazine as a substrate to catalyze the emission of luminescence, and the amino acid sequence beginning at the position corresponding to position 8 of SEQ ID NO: 1 is:

(VII) (SEQ ID NO: 330)

[GSAIVK]-{FE}-[FYW]-x-[LIVMFSYQ]-x-x-{K}-x-[NHGK]-x-[DE]-x-[LIVMFY]-[LIVMWF]-x-{G}-[LIVMAKRG], with no more than 5 differences, or more preferably no more than 4, 3, 2, or 1 difference, or most preferably no differences, wherein the differences occur in positions corresponding to pattern position 1, 2, 3, 5, 8, 10, 12, 14, 15, 17, or 18 of Formula (VII) according to Table 4. Differences may also include gaps or insertions between the pattern positions of Table 4.

TABLE 4

Protein sequence patterns

| Pattern position | PROSITE FABP pattern PS00214 | Other FABPs | OgLuc wt & variants | OgLuc pattern | OgLuc position | OgLuc wt sequence | Dinofl. Luc |
|---|---|---|---|---|---|---|---|
| 1 | [GSAIVK] (SEQ ID NO: 427) | | | [GSAIVK] (SEQ ID NO: 579) | 8 | G | G |
| 2 | {FE} | | | {FE} | 9 | D | R |
| 3 | [FYW] | | | [FYW] | 10 | W | W |
| 4 | x | | | x | 11 | Q | I |
| 5 | [LIVMF] (SEQ ID NO: 590) | SY | Q | [LIVMFSYQ] (SEQ ID NO: 591) | 12 | Q | T |
| 6 | x | | | x | 13 | T | [VI] |
| 7 | x | | | x | 14 | A | S |
| 8 | {K} | | | {K} | 15 | G | G |
| 9 | x | | | x | 16 | Y | G |
| 10 | [NHG] | K | | [NHGK] (SEQ ID NO: 580) | 17 | N | Q |
| 11 | [FY] | SILM (SEQ ID NO: 581) | {FY} | x | 18 | Q | [AVTK] (SEQ ID NO: 582) |
| 12 | [DE] | | | [DE] | 19 | D | [AE] |
| 13 | x | | | x | 20 | Q | F |
| 14 | [LIVMFY] (SEQ ID NO: 583) | | | [LIVMFY] (SEQ ID NO: 584) | 21 | V | I |
| 15 | [LIVM] (SEQ ID NO: 585) | W | F | [LIVMWF] (SEQ ID NO: 586) | 22 | L | K |
| 16 | {K} | | K | x | 23 | E | [EKTQ] (SEQ ID NO: 587) |
| 17 | {G} | | | {G} | 24 | Q | [AV] |
| 18 | [LIVMAKR] (SEQ ID NO: 588) | | G | [LIVMAKRG] (SEQ ID NO: 589) | 25 | G | [VI] |

Example 22—Generation of OgLuc Variants

Experimental Details

Unless otherwise stated, further variants of a starting OgLuc variant sequence with random substitutions were generated using the error-prone, mutagenic PCR-based system GeneMorph II Random Mutagenesis Kit (Stratagene; Daughtery, *PNAS USA*, 97(5):2029 (2000)), according to manufacturer's instructions, and NNK site saturation (Zheng et al., *Nucleic Acids Research*, 32:e115 (2004)).

Further variants of a starting OgLuc variant having specific mutations were generated using the oligo-based site-directed mutagenesis kit QuikChange Site-Directed Mutagenesis Kit (Stratagene; Kunkel, *PNAS USA*, 82 (2): 488 (1985)), according to the manufacturer's instructions.

The resulting variants were constructed in the context of pF1K FLEXI® vector for T7 promoter-based expression (Promega Corp.). Alternatively, the resulting variants were constructed in the context of pF4Ag vector (a version of the commercially-available pF4A (Promega Corp.), which contained T7 and CMV promoters modified to contain an *E. coli* ribosome-binding site with or without a C-terminal HALOTAG® (Promega Corp.; referred herein as "HT7") (Ohana et al., *Protein Expression and Purification*, 68:110-120 (2009)) to generate a fusion protein. For example, to obtain C1+A4E variants, NNK saturation mutagenesis experiments were performed in a pF1K vector background. The C1+A4E library was generated in a pF4Ag vector background with no HT7. The QC27, QC27-9a, and IVY libraries were generated in a pF4Ag vector background with a C-terminal HT7. The IV-based variants were generated in a pF4Ag vector background without HT7. The resulting vectors were used to transform KRX *E. coli* using techniques known in the art.

Generated OgLuc variants are named for the amino acid substitutions identified in the variant and/or for the *E. coli* clone that contained the variant, e.g., FIG. 6A shows, among other results, that *E. coli* clone 16C5 has the substitution Q20R.

Screening Details

Resulting libraries were expressed in *E. coli* and primarily screened with a robotic system for OgLuc variants having increased light output (i.e., increased luminescence, increased brightness, or increased light emission) or a change in relative specificity compared to the corresponding starting OgLuc variant. The robotic primary screen was conducted as follows: individual colonies from the generated library were used to inoculate minimal media in 96-well plates and grown at 37° C. for 17 to 20 hrs ("M1 culture"). The M1 culture was diluted 1:20 with fresh minimal media and grown at 37° C. for 17-20 hrs ("M2 culture"). The M2 culture was diluted 1:20 into induction media and grown 17-20 hrs at 25° C. with walk-away induction, i.e., autoinduction (Schagat et al., "KRX Autoinduction Protocol: A Convenient Method for Protein Expression." *Promega Notes*, 98:16-18 (2008)). The induction media contained rhamnose and glucose when novel coelenterazines PBI-3841, PBI-3842, PBI-3857, PBI-3880, PBI-3881, PBI-3886, PBI-3887, PBI-3897, PBI-3896, or PBI-3894 were used as substrates in the primary screen. The induction media did not contain rhamnose or glucose when native coelenterazine, known coelenterazine-h, or novel coelenterazines PBI-3840, PBI-3889, PBI-3899, or PBI-3900 were used as substrates in the primary screen. The use of the different induction media was determined based on the luminescence generated between C1+A4E and the novel coelenterazines, i.e., the induction media containing rhamnose and glucose were used with novel coelenterazines that generated less luminescence with C1+A4E compared to the other novel coelenterazines with C1+A4E.

Ten µL of induced cells were lysed using 60 µL lysis buffer containing 300 mM HEPES pH 8.0, 300 mM thiourea, 0.3× Passive Lysis Buffer ("PLB"; Promega Corp. Cat. No. E194A), 0.3 mg/mL lysozyme, and 0.003 U/µL RQ1 DNase and measured for luminescence with 50 µL assay buffer containing 150 mM KCl, 1 mM CDTA, 10 mM DTT, 0.5% TERGITOL® NP-9 (v/v), and 20 µM of a native, known, or novel coelenterazine as a substrate. Luminescence measurements for each variant were taken 3 min after reagent addition and relative luminescence unit (RLU) values were normalized to an average of 8 control wells of the corresponding starting OgLuc variant for each plate. Assay was completed on a TECAN® robotic system.

OgLuc variants of interest were sequenced using standard sequencing techniques known in the art to identify any additional amino acid substitutions in each such variant. A secondary screen using a non-robotic (manual) system was performed on the variant clones of interest. The manual screen was conducted as follows: Variant clones were grown, in triplicate, in 96-well plates and expressed and assayed as described for the automated assay except the assay buffer was added manually with a multichannel pipette. For each variant, luminescence was measured, averaged, and normalized to the corresponding starting OgLuc variant. Luminescence measurements were made using a TECAN® INFINITE® F500 luminometer.

Determining Change in Relative Specificity

Relative substrate specificity was determined by dividing the luminescence of a luciferase in the presence of a test coelenterazine substrate by the luminescence of the luciferase in the presence of a reference coelenterazine substrate. For example, relative specificity was determined by dividing the luminescence of a luciferase with a novel coelenterazine of the present invention by the luminescence of the luciferase with a different coelenterazine (e.g., native or known coelenterazine, or a different novel coelenterazine of the present invention). The test coelenterazine substrate and the reference coelenterazine substrate that were compared were considered a comparison substrate pair for determining relative substrate specificity.

A change in relative substrate specificity was determined by dividing the relative substrate specificity of a test luciferase using a comparison substrate pair by the relative substrate specificity of a reference luciferase using the same comparison substrate pair. For example, a change in relative specificity was determined by dividing the relative substrate specificity of a test luciferase with a novel coelenterazine of the present invention compared to a different coelenterazine (e.g., native or known coelenterazine or a different novel coelenterazine of the present invention), by the relative substrate specificity of a reference luciferase with the same novel coelenterazine of the present invention compared to the same different coelenterazine used for the test luciferase.

The luminescence with one novel coelenterazine was compared to the luminescence with a different novel coelenterazine. The luminescence with one native or known coelenterazine was compared to the luminescence with another native or known coelenterazine. The luminescence with one native or known coelenterazine was compared to the luminescence with a novel coelenterazine.

An increase in luminescence (RLUs) for the OgLuc variant compared to the corresponding starting OgLuc template for novel coelenterazine and a decrease or no change in luminescence for a reference coelenterazine was indicative of a change in relative specificity. A decrease in luminescence of an OgLuc variant for both the novel and reference coelenterazines compared to the corresponding starting OgLuc, but the luminescence of the OgLuc variant with the novel coelenterazine decreasing more, was also indicative of a change in relative specificity. An increase in luminescence of the OgLuc variant compared to the corresponding starting OgLuc for the novel and reference coelenterazines indicated an improvement in activity/stability/expression. If the luminescence of the OgLuc variant with both the novel and the reference coelenterazines increased, but the increase in luminescence with the novel coelenterazine was greater, it indicated an increase in relative specificity and an improvement in activity/stability/expression of the OgLuc variant.

A. C1+A4E Variants

Figure 4:
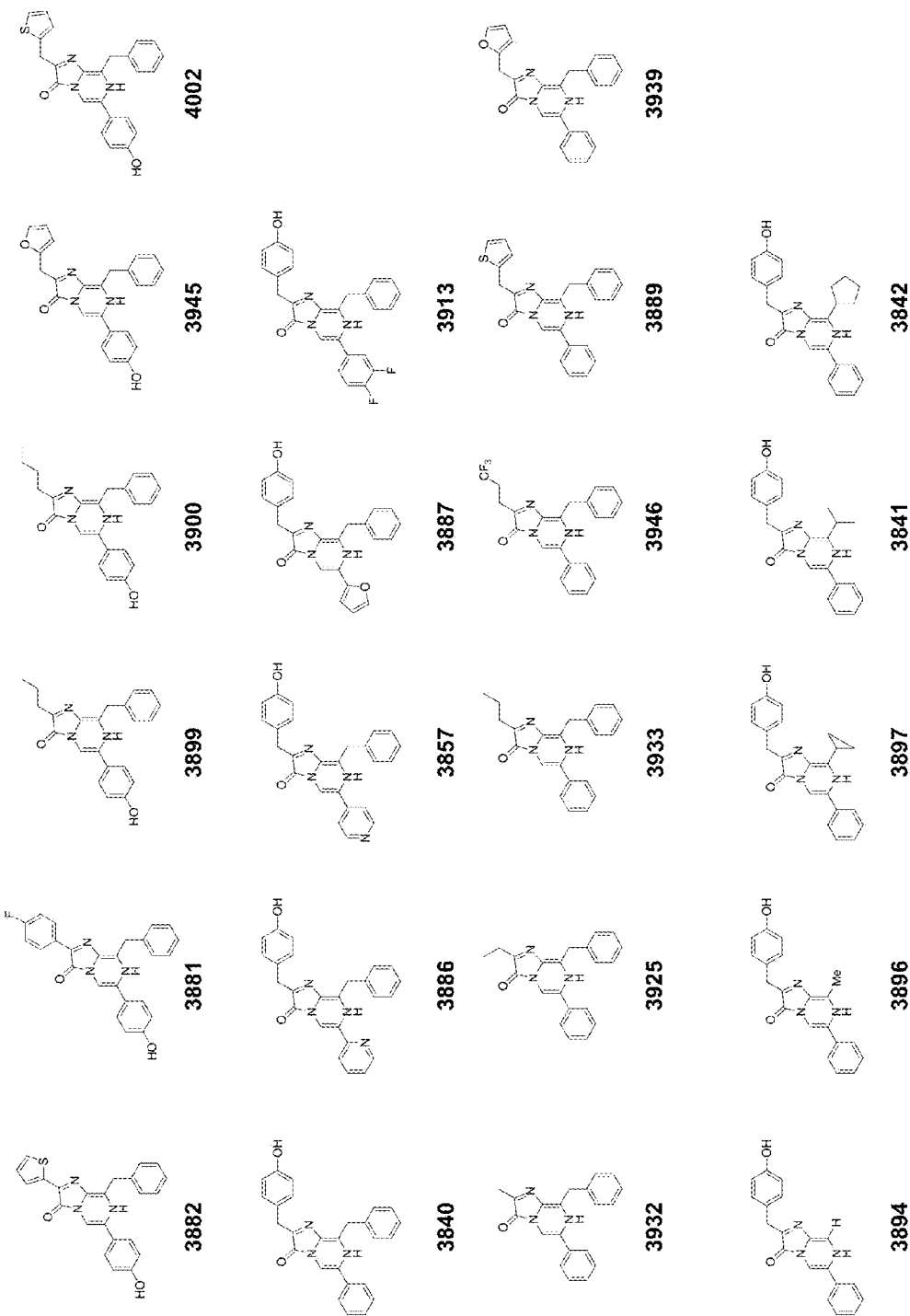
FIG. 4 shows the chemical structure of various novel coelenterazines of the present invention.
Figure 5:
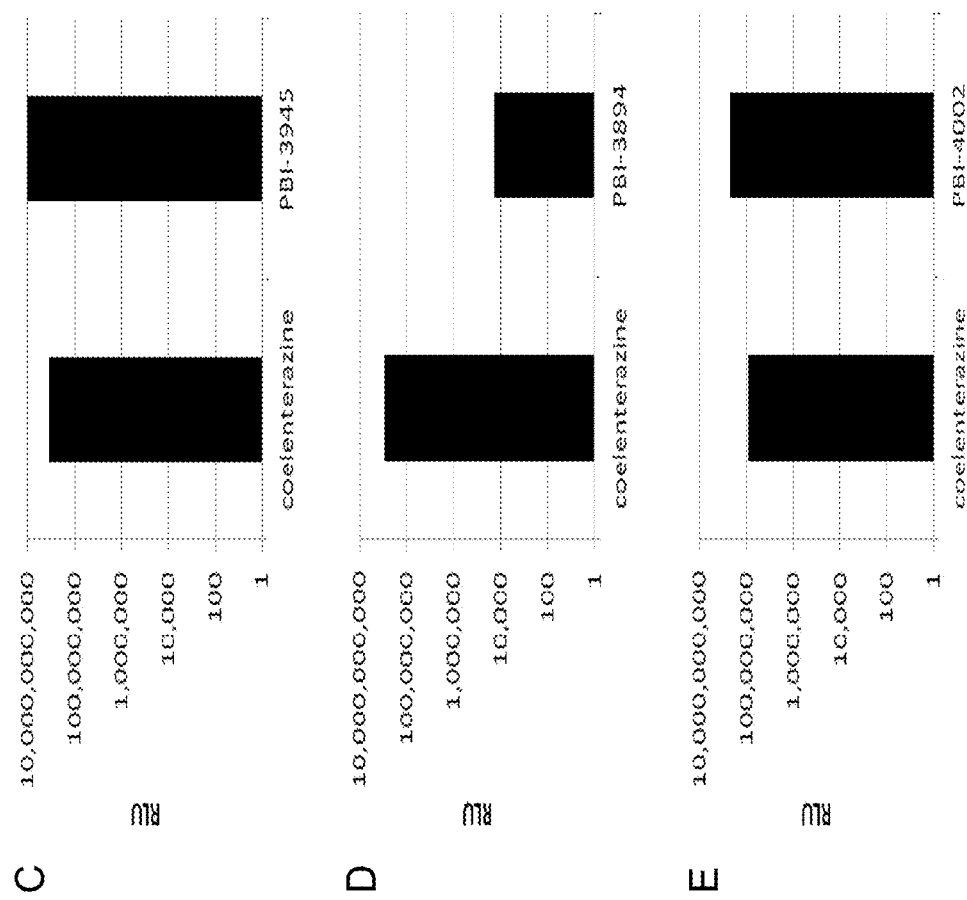
FIGS. 5A-G show the luminescence (RLUs) generated from lysed bacterial cells expressing C1+A4E using native, known, and novel coelenterazine as substrates.
Figure 5:
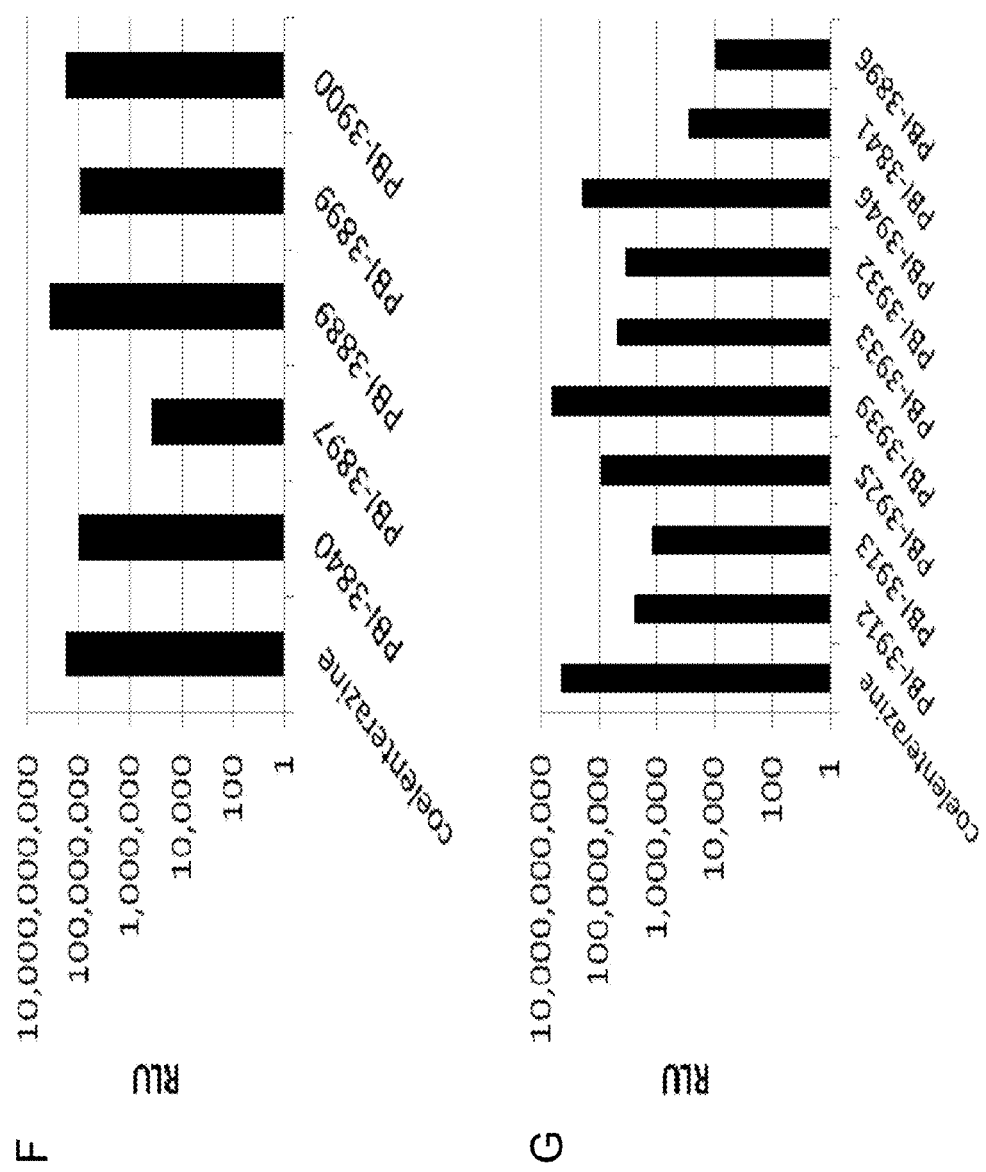

C1+A4E (SEQ ID NOs: 2 and 3), previously described in U.S. Serial application Ser. No. 12/773,002 (U.S. Published Application No. 2010/0281552), was used as a primary starting sequence (i.e., the parental sequence) for generating additional, synthetic OgLuc variants. C1+A4E has the following amino acid substitutions: A4E, Q11R, A33K, V44I, A54F, P115E, Q124K, Y138I, and N166R, relative to SEQ ID NO: 1. Luminescence of C1+A4E containing bacterial lysates, using the novel coelenterazines described in Examples 1-14 (see FIG. 4 for examples) as substrates, was measured as described previously and compared to the luminescence using native and known coelenterazines as substrates (FIGS. 5A-G). FIG. 5A shows the luminescence of C1+A4E using native coelenterazine ("coelenterazine"), known PBI-3880, and novel coelenterazines PBI-3842, PBI-3857, PBI-3881, PBI-3882, PBI-3886, and PBI-3887 as substrates. The luminescence measurements using known and novel coelenterazines were normalized to the luminescence of C1+A4E using native coelenterazine and the fold-decrease compared to native coelenterazine (FIG. 5B). FIGS. 5C-E show the luminescence of C1+A4E using native coelenterazine and novel coelenterazines PBI-3945, PBI-3894, and PBI-4002, respectively. FIG. 5F shows the luminescence of C1+A4E using native coelenterazine and novel coelenterazines PBI-3840, PBI-3897, PBI-3889, PBI-3899, and PBI-3900. FIG. 5G shows the luminescence of C1+A4E using native coelenterazine, known coelenterazine PBI-3912 and novel coelenterazines PBI-3913, PBI-3925, PBI-3939, PBI-3933, PBI-3932, PBI-3946, PBI-3841, and PBI-3896. The data indicates the C1+A4E variant can use each of the novel coelenterazines as substrates.

C1+A4E variants were generated that had at least the amino acid substitutions identified in C1+A4E, unless otherwise indicated. A library (Library 1) of 4400 variant clones of C1+A4E was generated by random mutagenesis as described previously and screened as described previously for improvement in relative specificity change and/or activity change, e.g., brightness. The variants were primarily screened with native coelenterazine, known coelenterazine-h, known PBI-3880, and novel coelenterazines PBI-3840, PBI-3841, PBI-3842, PBI-3857, PBI-3881, PBI-3886, PBI-3887, PBI-3889, PBI-3897, and PBI-3900 as substrates. In addition, half of the variants were screened with novel coelenterazines PBI-3896 and PBI-3894 as substrates. Plates containing variants having known mutations of interest identified from screening previous novel compounds were selected. Variants that showed improvement (either relative specificity change or activity change) for one or more of the novel coelenterazines tested in the primary screen were isolated, sequenced, and screened in a secondary screen.

In the secondary manual screen, the variants were tested with known coelenterazines PBI-3912, coelenterazine-h, coelenterazine-hh, 2-methyl coelenterazine, and coelenterazine v; and novel coelenterazines PBI-3840, PBI-3897, PBI-3889, PBI-3899, PBI-3900, PBI-3925, PBI-3944, PBI-3932, PBI-3945, PBI-3913, and PBI-3896 as substrates. FIGS. 6A-D summarize the average luminescence normalized to C1+A4E for the variants ("Clone"). FIGS. 6A-D summarize the substitutions in these variants ("AA sequence"), which had at least one of the following additional amino acid substitutions: A14V, G15R, Q18L, Q20R, L22I, E23K, L27V, L27M, K33N, T39I, E49K, F54S, F54I, D55G, I56V, V58I, V58L, I59T, S66T, G67S, F68S, L72Q, M75K, I76N, F77T, F77C, K89E, I90V, I90T, L92H, H93R, M106K, Y109F, P113T, I117F, T126R, V127A, L136M, D139G, P145L, S148T, C164S, or A169V.

Amino acid substitutions at position 54, 92, and 109 were of interest as substitutions at these positions provided greater light output or improved relative specificity, i.e., specificity away from native coelenterazine and towards at least one novel coelenterazine, as shown in FIGS. 6A-C. The amino acid substitution F54I in clone 29H7 provided greater light output with native coelenterazine and several of the novel coelenterazines. The amino acid substitution Q18L in clone 40H11, the amino acid substitution L92H in clone 04A12, and the amino acid substitution Y109F in clone 43F9 provided improved relative specificity.

Table 5 lists C1+A4E variants with an additional amino acid substitution at position 77, 92, or 109 ("AA change"), generated as described previously. These variants were analyzed for increased light output as described previously, i.e., screened for variants that were at least 1.3× brighter than C1+A4E, using native coelenterazine, known coelenterazine-hh, and novel coelenterazines PBI-3939, PBI-3894, PBI-3896, PBI-3897, PBI-3932, or PBI-3925 as a substrate. The following additional substitutions yielded a variant that was at least 1.3× brighter than C1+A4E: L92G, L92Q, L92S, L92A, L92M, L92H, L92Y, F77W, F77Y, F77S, F77T, F77V, F77A, F77G, F77C, F77D, F77M, and Y109F. As shown in Table 5, L92H, F77W and F77A substitutions had the most dramatic improvements with PBI-3897, PBI-3896, and PBI-3932.

TABLE 5

Site Saturation of Positions 77, 92 and 109

| AA Change | native | hh | PBI-3939 | PBI-3894 | PBI-3896 | PBI-3897 | PBI-3932 | PBI-3925 |
|---|---|---|---|---|---|---|---|---|
| L92G | 2.2 | | | | | | | |
| L92Q | 2 | 1.8 | 1.6 | 1.3 | 1.4 | 2.8 | 1.4 | 3.4 |
| L92S | 2.9 | | | | 1.5 | 2.9 | 2.7 | 6 |
| L92A | 2.5 | 1.3 | | | | | | |
| L92M | | 1.3 | | | | | | |
| L92H | | | | | 2.2 | 21 | 9.1 | 3.4 | 5.9 |
| L92Y | | | | | | | | 2.5 |
| F77W | 1.4 | | 1.4 | 1.4 | 8.3 | 3.2 | 1.7 | 2.3 |
| F77Y | | | | | 1.6 | 1.3 | 4.9 | 6.5 |
| F77S | | | | | | | 2.6 | |
| F77T | | | | | | | 2.3 | |
| F77V | | | | | | | 2.3 | |
| F77A | | | | | | | 7.9 | 2.5 |
| F77G | | | | | | | 3.1 | |
| F77C | | | | | | | 2.3 | |
| F77D | | | | | | | 1.5 | |
| F77M | | | | | | | 1.5 | 1.6 |
| Y109F | | | | | | 1.34 | 14 | |

Additional C1+A4E variants (Group A) were generated by site-directed mutagenesis as described previously to have an additional substitution in at least one of the following amino acid positions relative to SEQ ID NO: 1: 18, 20, 54, 59, 72, 77, 89, 92, 109, 113, 127, 136, or 164. These amino acid positions were chosen because, based on the primary and secondary screens of Library 1, substitutions at these positions had increased total light output compared to C1+A4E using at least one of the following as a substrate: novel coelenterazines PBI-3841, PBI-3896, PBI-3897, PBI-3894, PBI-3925, or PBI-3932, or known coelenterazines 2-methyl coelenterazine or PBI-3912. FIG. 7 lists the variants ("Clone") and the additional amino acid substitutions contained in each variant. Variant clones were assayed in triplicate as described for the secondary manual screen as described previously and normalized to C1+A4E. FIGS. 8A-B and 9 show the normalized average luminescence of the variants listed in FIG. 7 with various coelenterazines as substrates. FIGS. 8A-B and 9 show variants with either large increases in luminescence for the listed novel compounds compared to C1+A4E or no change or a decrease in luminescence for the known coelenterazine compared to C1+A4E. Clone QC27, which has additional amino acid substitutions Q18L, F54I, L92H, and Y109F, had a 561.32-fold-increase in luminescence with PBI-3896, a 392.98-fold-increase with PBI-3894, and a 283.85-fold-increase with PBI-3896 compared to C1+A4E. This data shows that Q18L, L92H, and Y109F can be combined with each other and with additional substitutions to result in variants with improved relative specificity.

Other substitutions of interest identified from Library 1 were combined to generate additional variants (Group B) (FIG. 10). Additional amino acid substitutions were made in at least one of the following amino acid positions relative to SEQ ID NO: 1: 18, 20, 54, 71, 77, 90, 92, 109, or 127. These substitutions showed improvement with at least one of the following novel coelenterazines as a substrate: PBI-3841, PBI-3896, PBI-3897, PBI-3894, PBI-3925, or PBI-3932. These variants were assayed as described for Group A variants using native coelenterazine, known coelenterazine-hh, and novel coelenterazines PBI-3939, PBI-3945, PBI-3840, PBI-3932, PBI-3925, PBI-3894, and PBI-3896. Variant clones were assayed in triplicate as described for the secondary manual screen as described previously and normalized to C1+A4E. FIG. 11 shows the normalized average luminescence of the variants listed in FIG. 10 with the various coelenterazines as substrates. FIG. 11 shows variants with either large increases in luminescence for the listed novel coelenterazines compared to C1+A4E or no change or a decrease in luminescence for the native and known coelenterazine compared to C1+A4E.

Additional variants were generated with the additional amino acid substitution I90V and/or Y109F (Group C) and compared to variants generated from Group A or B (see FIG. 12). Clones containing variants with an I90V substitution ("I90V"), a Y109F substitution ("Y109F"), or both substitutions ("LE2") were compared to clones QC #27, QC#2 E7, QC#2 F4, and QC#1 A11 using assays as described for Group A recombinants with native coelenterazine, known coelenterazine-hh, and novel coelenterazines PBI-3939, PBI-3945, PBI-3889, PBI-3840, PBI-3925, PBI-3932, PBI-3894, PBI-3896, and PBI-3897 as substrates (FIG. 12). Variant clones were assayed in triplicate as described for the secondary manual screen as previously described and normalized to C1+A4E (FIG. 12). FIG. 12 shows variants with either large increases in luminescence for the listed novel coelenterazines compared to C1+A4E and no change or a decrease in luminescence for the native or known coelenterazine compared to C1+A4E. FIG. 12 shows that I90V provided greater light output for native coelenterazine and several of the novel substrates.

B. QC27 Variants

The variant QC27 (SEQ ID NOs: 4 and 5) from A, which has additional amino acid substitutions Q18L, F54I, L92H, and Y109F, was cloned into a pF4A modified vector as described previously to create a C-terminal HT7 (Promega Corp.) fusion protein ("QC27-HT7") (SEQ ID NOs: 44 and 45). 4400 variants of QC27-HT7 (Library 2) were generated by random mutagenesis as described previously, and primarily screened for increased relative specificity change as described previously using native coelenterazine and novel coelenterazines FBI-3896 and FBI-3897 as substrates. Variant clones were selected, sequenced, and assayed in a secondary manual screen as described previously using native coelenterazine, known coelenterazine-hh, and novel coelenterazines FBI-3897, FBI-3896, and FBI-3894 as substrates.

FIG. 13 lists the additional amino acid substitutions ("Sequence") identified in these variants ("Sample"), and the luminescence of the variants using native coelenterazine, known coelenterazine-hh, and novel coelenterazines PBI-3897, PBI-3896, and PBI-3894 as substrates in the secondary screen normalized to the corresponding starting QC27-HT7. The variants in FIG. 14, had at least one of the following additional amino acid substitutions: F1I, R11Q, L18I, L18Q, V21L, V21M, L22F, F31I, Q32H, V45E, L46Q, S47P, G48R, E49D, G51E, D55E, G67S, F68Y, F68L, Q69H, L72Q, E74K, E74I, M75K, I76F, I76V, H86R, I90T, H92Q, H92R, T96A, V98F, I99V, I99T, V102M, M106I, F109Y, L142V, V158I, T159S, L168F, or G170R (the G170R is located in the linker region between HT7 and the OgLuc variant).

The amino acid substitutions F68Y in variant 24B12, L72Q in variant 29C4, and M75K in variant 3H11 each provided greater light output for native coelenterazine and several of the novel substrates. The amino acid substitutions V21L in variant 25A11 and H92R in variant 1B6 provided improved relative specificity. Both of these substitutions were cases where luminescence signals were down using the novel coelenterazines as substrates, but were down more using native and known coelenterazines as substrates.

Additional QC27-HT7 variants were generated to have specific amino acid substitutions (FIG. 14) using site-directed mutagenesis as described previously. Additional substitutions were made in at least one of the following amino acid positions relative to SEQ ID NO: 1: 21, 68, 72, 75, 76, 90, 92, and 158, as these positions showed improvement in relative specificity change as shown in FIG. 14. FIG. 15 shows the luminescence of the QC27-HT7 variants using native coelenterazine, known coelenterazine-hh, and novel coelenterazines PBI-3897, PBI-3841, PBI-3896, and PBI-3894 as substrates normalized to the corresponding starting QC27-HT7. As seen in FIG. 15, combining the three amino acid substitutions F68Y, L72Q, and M75K with V158I, as for example in variant QC27#1, provided greater light output for each coelenterazine tested.

C. QC27-9a Variants

The variant QC27-9a (SEQ ID NOs: 6 and 7) from B, a QC27-HT7 fusion protein with additional amino acid substitutions V21L, H29R, F68Y, L72Q, M75K, and V158I, was used as a starting sequence to generate a library. 4400 variants of QC27-9a (Library 3) were generated by random mutagenesis as described previously and screened for increased relative specificity change using native coelenterazine and novel coelenterazines PBI-3841 and PBI-3897. Variant clones were selected, sequenced, and assayed in a secondary manual screen as described previously using native coelenterazine, known coelenterazine-hh, known coelenterazine-h, and novel coelenterazines PBI-3841 and PBI-3897 as substrates. FIG. 16 lists the additional substitutions ("AA change") identified in the variants ("Sample"), and the average luminescence of the variants using native coelenterazine, known coelenterazine-hh, known coelenterazine-h, and novel coelenterazines PBI-3841 and PBI-3897 as substrates in the secondary screen normalized to the corresponding starting QC27-9a. The increase in relative specificity represents cases where there was a decrease in luminescence for the variant with the novel, native, and known coelenterazines compared to the starting template, but luminescence with the native and known coelenterazines decreased more. For example, the variant 30D12 with the amino acid substitution L22F had an approximately three-fold loss in activity with the novel coelenterazines PBI-3841 and PBI-3897. However, with native coelenterazine, known coelenterazine-h, and known coelenterazine-hh, the luminescence of the variant 30D12 was down by ten-fold or more.

Figure 17:
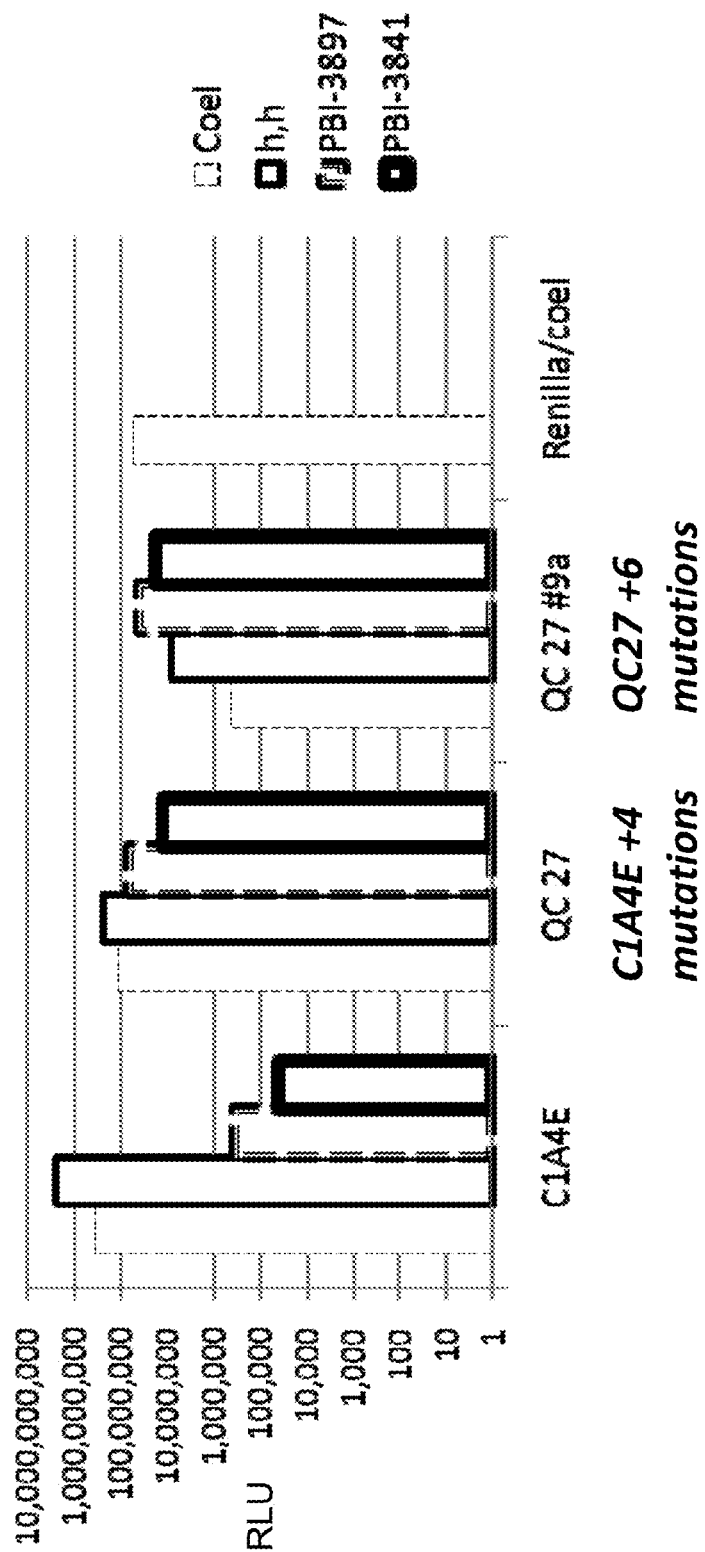
FIG. 17 shows the luminescence generated from lysed bacterial cells expressing various OgLuc variants and humanized Renilla luciferase (hRL) using native coelenterazine ("Coel"), known coelenterazine-hh ("h,h"), and novel coelenterazines PBI-3897 and PBI-3841 as substrates.

FIG. 17 shows a comparison of the luminescence of C1+A4E, QC27-HT7 and QC27-9a compared to humanized *Renilla* luciferase (referred herein as "hRL") (SEQ ID NOs: 30 and 31) using native coelenterazine, known coelenterazine-hh, and novel coelenterazines PBI-3841 and PBI-3897 as substrates. Although the reaction of QC27-9a with PBI-3897 was brighter than QC27-9a with PBI-3841 (see FIG. 17), the evolution trend, i.e., magnitude of improvement in luminescence, was greatest for PBI-3841 (Table 6). Combining the improvement in luminescence (440-fold) with the decrease in luminescence for native coelenterazine (800-fold) indicated a change in relative specificity (350,000-fold) of QC27-9a using PBI-3841 compared to native coelenterazine.

TABLE 6

The Change in Relative Specificity of the OgLuc Variants for PBI-3897 and PBI-3841 Compared to Native Coelenterazine and coelenterazine-hh.

| Compound | Evolution trend: C1A4E to QC27 #9a | Change in relative specificity (novel coelenterazine/ native coelenterazine) |
|---|---|---|
| coelenterazine | DOWN 800X | |
| coelenterazine-hh | DOWN 300X | |
| PBI-3897 | UP 100X | 80,000X |
| PBI-3841 | UP 440X | 350,000X |

D. IVY Variants

IVY (SEQ ID NOs: 8 and 9), a C1+A4E variant with additional amino acid substitutions F54I, I90V, and F77Y, was cloned into a pF4A modified vector as described previously to create a C-terminal HT7 fusion protein ("IVY-HT7"). 4400 variants of IVY-HT7 (Library 4) were generated by random mutagenesis and screened for increased light output (i.e., increased brightness) and increased relative specificity using native coelenterazine, known coelenterazine-hh, and novel coelenterazines PBI-3840, PBI-3889, PBI-3925, PBI-3932, and PBI-3945 as substrates. Variant clones were selected, sequenced, and assayed in triplicate in a secondary screen as described previously using native coelenterazine, known coelenterazine-hh, and novel coelenterazines PBI-3889, PBI-3939, PBI-3945, and PBI-4002 as substrates. FIGS. 18 and 19 lists the additional substitutions ("AA change") identified in the variants ("Sample") and the average luminescence of the variants normalized to IVY-HT7 using native coelenterazine, known coelenterazine-hh, and novel coelenterazines PBI-3889, PBI-3939, PBI-3945, and PBI-4002 as substrates in the secondary screen. FIG. 18 lists those variants chosen based on performance with PBI-3945 (Group A), which had at least one of the following amino acid substitutions: Q18H, D19N, Q20P, Q32P, K33N, V38I, V38F, K43N, I44F, E49G, I60V, Q69H, I76N, Y77N, Y94F, G95S, G95D, F110I, V119M, K124M, L149I, or R152S. FIG. 19 lists those variants chosen based on performance with PBI-3889 (Group B), which had at least one of the following amino acid substitutions: F6Y, Q18L, L27V, S28Y, Q32L, K33N, V36E, P40T, Q42H, N50K, G51R, H86L, N135D, or I155T.

Additional IVY-HT7 variants were generated to have additional specific amino acid substitutions using site-directed mutagenesis as described previously. FIG. 20 lists variants with at least one of the following additional amino acid positions relative to SEQ ID NO: 1: 19, 20, 27, 32, 38, 43, 49, 58, 77, 95, 110, and 149, as these substitutions were identified in the variants of FIG. 18, which showed specificity towards PBI-3945 and PBI-4002. FIG. 21 shows the luminescence of the variants listed in FIG. 20 normalized to IVY-HT7 using native coelenterazine, known coelenterazine-h, known coelenterazine-hh, and novel coelenterazines PBI-3939, PBI-3945, PBI-4002, PBI-3932 and PBI-3840 as substrates. None of the variants showed an improvement over IVY-HT7, but there were instances, such as variant C5.19 (SEQ ID NOs: 12 and 13) where luminescence with native or a known coelenterazine decreased about 3-4 logs, but luminescence with PBI-3945 and PBI-4002 decreased only two-fold. Variant C5.19 has additional amino acid substitutions L27V, V38I, and L149I.

FIG. 22 lists variants with at least one of the following additional amino acid positions relative to SEQ ID NO: 1: 6, 18, 27, 28, 33, 34, 36, 40, 50, 51, 135, and 155, as these substitutions were identified in the variants of FIG. 19, which showed specificity towards PBI-3889 and PBI-3939. FIG. 23 shows the luminescence of the variants listed in FIG. 21 using native coelenterazine, known coelenterazine-h, known coelenterazine-hh, and novel coelenterazines PBI-3939, PBI-3945, PBI-3889, PBI-4002, PBI-3932, and PBI-3840 as substrates normalized to IVY-HT7. Luminescence decreased for each of the variants compared to IVY-HT7. Variant C1.3 (SEQ ID NOs: 10 and 11) had about 2000-fold more luminescence with PBI-3939 than with native or known coelenterazine. Variant C1.3 has additional amino acid substitutions F6Y, K33N, N135D, and I155T.

Figure 24:
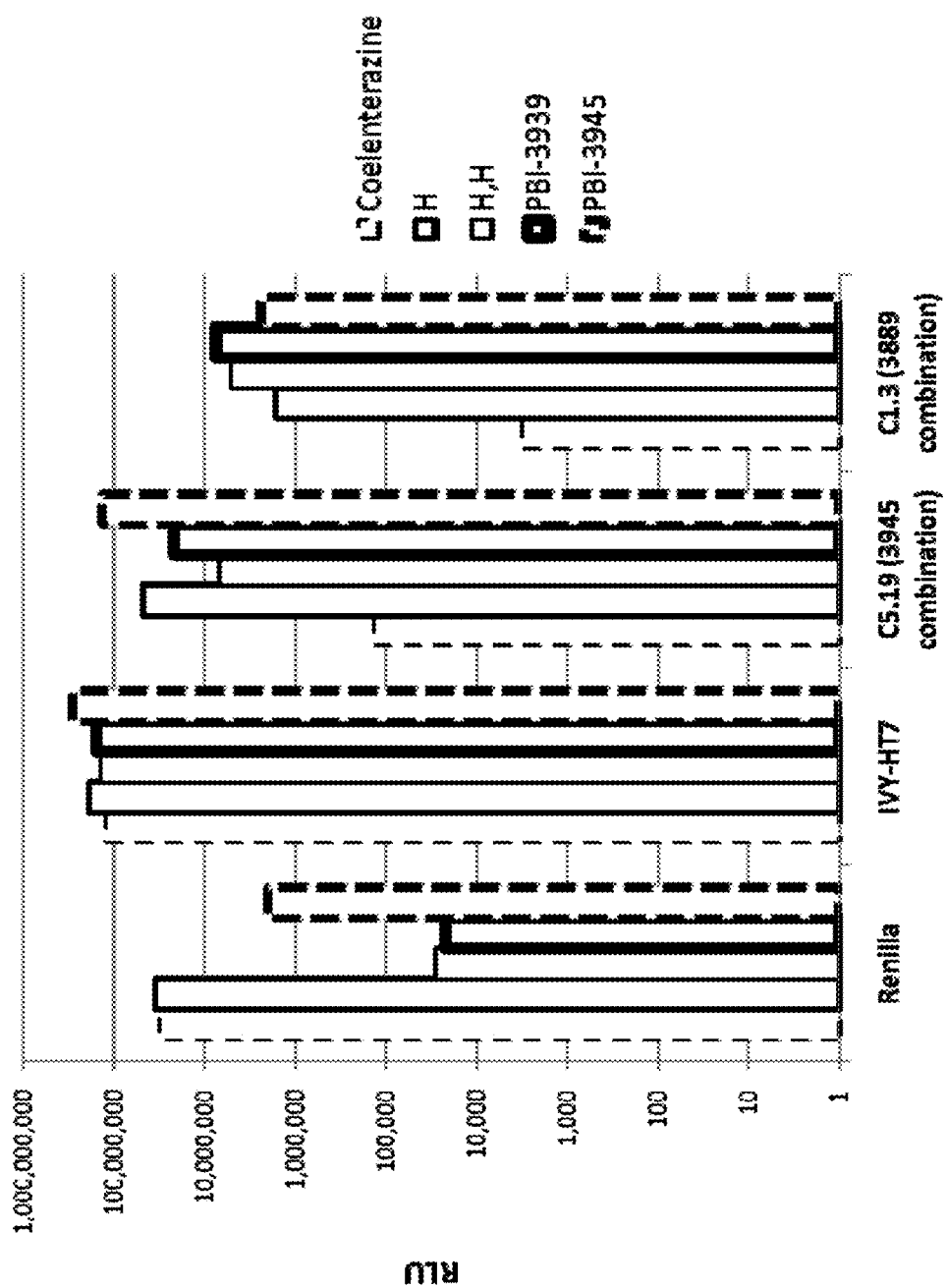
FIG. 24 shows the luminescence generated from lysed bacterial cells expressing various OgLuc variants and hRL ("Renilla") using native coelenterazine ("Coelenterazine"), known coelenterazine-h ("H"), known coelenterazine-hh ("H,H"), and novel coelenterazines PBI-3939 and PBI-3945 as substrates.

The best IVY-HT7 variants for relative specificity change compared to hRL and IVY-HT7 were C5.19, which had the best luminescence with PBI-3945, and C1.3, which had the best luminescence with PBI-3889. FIG. 24 shows the luminescence of hRL, IVY-HT7, C5.19 (a C-terminal HT7 fusion), and C1.3 (a C-terminal HT7 fusion) with native coelenterazine, known coelenterazine-h, known coelenterazine-hh, and novel coelenterazines PBI-3939 and PBI-3945.

E. IV Variants

Figure 25:
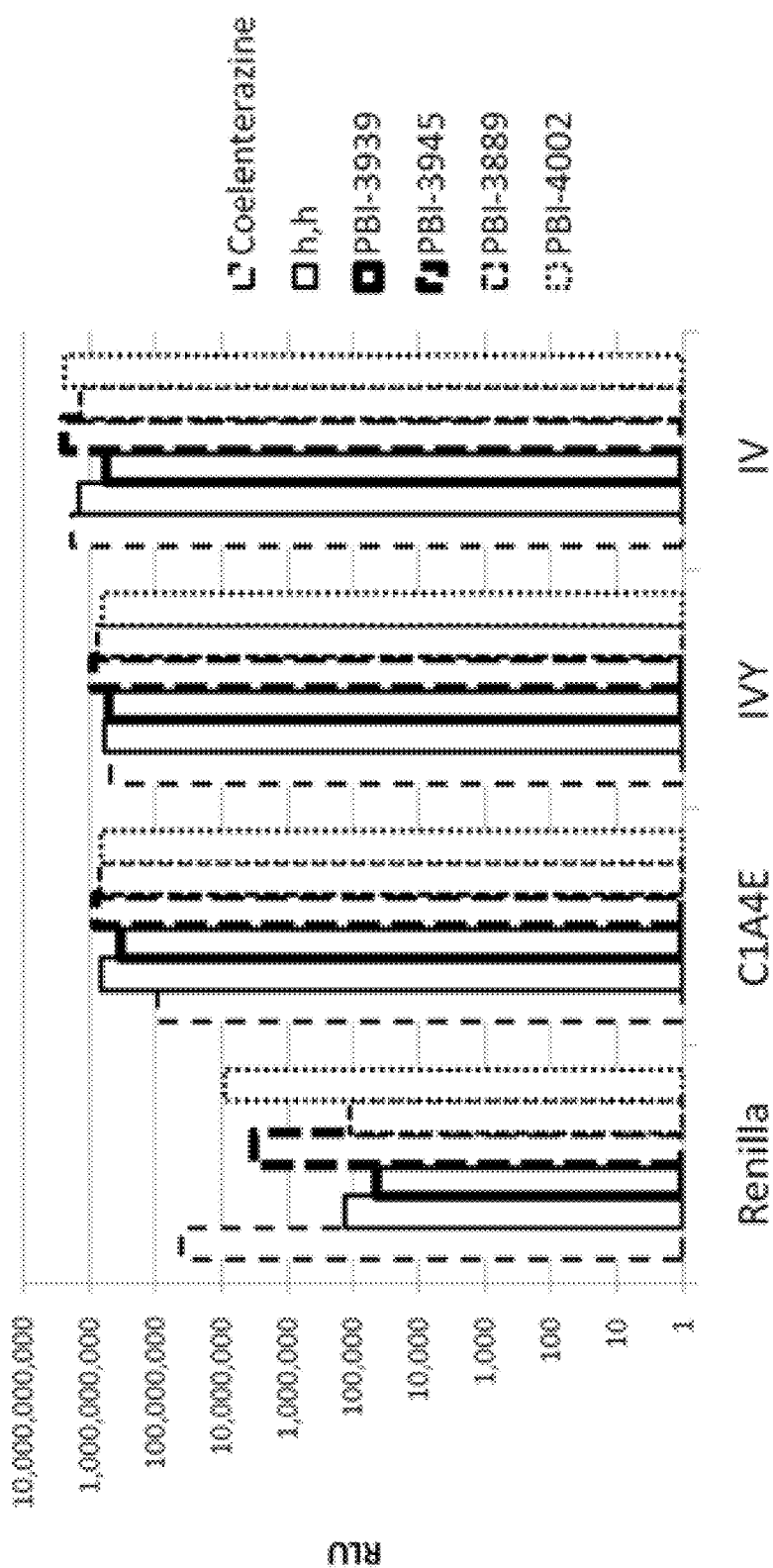
FIG. 25 shows the luminescence generated from lysed bacterial cells expressing various OgLuc variants and hRL ("Renilla") using native coelenterazine ("Coelenterazine"), known coelenterazine-hh ("h,h"), and novel coelenterazines PBI-3939, PBI-3945, PBI-3889, and PBI-4002 as substrates.

IV (SEQ ID NOs: 14 and 15), a C1+A4E variant with additional amino acid substitutions F54I and I90V, was generated as previously described. To determine the brightest variant for use as a transcriptional reporter, luminescence was measured as described previously provided for C1+A4E (SEQ ID NOs: 2 and 3), IVY (SEQ ID NOs: 8 and 9), and IV (SEQ ID NOs: 14 and 15) using native coelenterazine, known coelenterazine-hh, and novel coelenterazines PBI-3939, PBI-3945, PBI-3889, and PBI-4002 as substrates. hRL was used as a control. As seen in FIG. 25, IV was brighter than both C1+A4E and IVY. The amino acid substitution F54I in IV provided greater light output for native coelenterazine and several of the novel substrates. All three variants were brighter than hRL with the tested coelenterazines.

The data from A, B and D (i.e., screenings of the libraries generated from C1+A4E, IVY, and QC27 as the starting sequences) were reviewed to determine those additional amino acid substitutions with increased light output (i.e., increased brightness) with a variety of coelenterazines. IV variants were generated as described previously to have additional substitutions which had reduced specificity for native coelenterazine by two- to ten-fold. As listed in FIG. 26, the IV variants ("clone") had an additional amino acid substitution ("Sequence") of at least one of the following amino acid substitutions: F11I, E4K, Q18L, L27V, K33N, V38I, F68Y, M70V, L72Q, M75K, or V102E.

Sixteen plates of variant clones for all combinations of amino acid substitutions were primarily screened and assayed using the automated robot method described previously with native coelenterazine, known coelenterazine-h, known coelenterazine-hh, and novel coelenterazines PBI-3889 and PBI-3945 as substrates. Variants with improved luminescence were selected, sequenced, and assayed in triplicate using the manual screen as described previously. Luminescence was measured using native coelenterazine, known coelenterazine-h, known coelenterazine-hh, and novel coelenterazines PBI-3889, PBI-3939, PBI-3945, and PBI-4002 as substrates. Corresponding starting sequences IV and hRL were used as controls.

FIG. 26 lists the variants, and the additional amino acid substitutions identified in the variants. FIG. 27 shows the average luminescence of the variants in the secondary screen normalized to IV. Variant 8A3 (SEQ ID NOs: 26 and 27), which has additional amino acid substitutions F11I, L27V, and V38I, had improved relative specificity with novel coelenterazines, but was not brighter than IV. Variant 8F2 (SEQ ID NOs: 46 and 47), which has additional amino acid substitution L27V, offered improved relative specificity and brightness with 3 of the 4 novel coelenterazines used. Variant 9B8 (SEQ ID NOs: 18 and 19), which has additional amino acid substitutions Q18L, F68Y, L72Q, and M75K, was brighter for all substrates and offered some relative specificity advantage over native coelenterazine as well. Variant 9F6 (SEQ ID NOs: 20 and 21), which has additional amino acid substitutions Q18L, L27V, V38I, F68Y, L72Q, and M75K, showed similar improvements as was seen with 8F2. Variant 15C1 (SEQ ID NOs: 16 and 17), which has additional amino acid substitutions E4K, K33N, F68Y, L72Q, and M75K, was brighter for all novel coelenterazines, but did not have any improved relative specificity benefit. The amino acid substitution Q18L in variant 1D6 provided improved relative specificity, i.e., away from native coelenterazine and towards novel substrates, in the context of IV. In general, the amino acid substitution L27V provided improved relative specificity in the context of IV.

Figure 28:
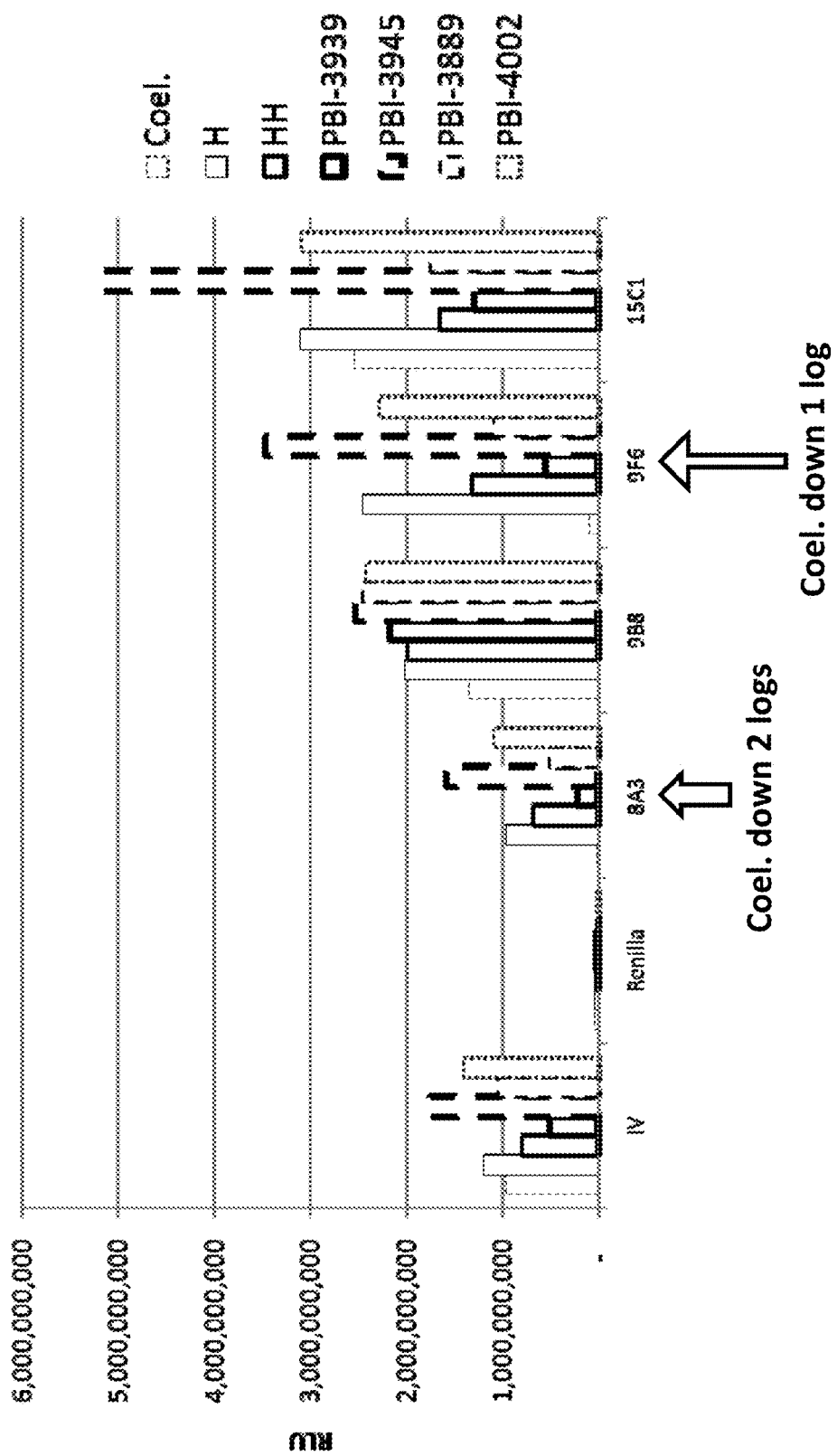
FIG. 28 shows the luminescence generated from lysed bacterial cells expressing various OgLuc variants and hRL ("Renilla") using native coelenterazine ("Coel."), known coelenterazine-h ("H"), known coelenterazine-hh ("H,H"), and novel coelenterazines PBI-3939, PBI-3945, PBI-3889, and PBI-4002 as substrates.

FIG. 28 shows the luminescence of the 8A3, 9B8, 9F6, and 15C1 variants in the secondary screen using native coelenterazine, known coelenterazine-hh, known coelenterazine-h, and novel coelenterazines PBI-3939, PBI-3945, PBI-3889, and PBI-4002 as substrates compared to IV and hRL. Variant 8A3 had 2 logs decrease in brightness with native coelenterazine compared to IV. Variant 9F6 had 1 log decrease in brightness with native coelenterazine compared to IV. Variant 15C1 with PBI-3945 was the brightest, but the signal half-life was short (see Example 27).

F. 9B8 Variants

The 9B8 variant from E was further modified to generate additional variants with increased light emission and/or improved relative specificity for PBI-3939. Amino acid substitution L72Q appeared to be a beneficial amino acid substitution for increased light emission (i.e., brightness) as this substitution was identified in the variants 9B8, 9F6, and 15C1, all of which showed improved light emission. To determine if other amino acid substitutions at position 72 would provide similar increases in brightness, additional variants of 9B8 were generated as described previously by saturating position 72 with alternative residues. Four replicates of E. coli lysates were prepared and analyzed for brightness as described previously using PBI-3939 as a substrate except the assay buffer contained 10 mM CDTA, 150 mM KCl, 10 mM DTT, 100 mM HEPES, pH 7.0, 35 mM thiourea, and 0.5% TERGITOL® NP-9 (v/v). Table 7 lists 9B8 variants ("Variant") with similar or improved luminescence compared to 9B8 as indicated by luminescence normalized to 9B8 ("RLU (normalized to 9B8)"), i.e., fold improvement. The amino acid substitutions of A, G, N, R, and M at position 72 provided at least the same brightness benefit as amino acid Q, i.e., 1-fold.

TABLE 7

Variants with Similar Luminescence Compared to Variant 9B8.

| Variant | RLU (normalized to 9B8) |
| --- | --- |
| 9B8 + Q72A | 1.1 |
| 9B8 + Q72G | 1 |
| 9B8 + Q72N | 1 |
| 9B8 + Q72R | 1 |
| 9B8 + Q72M | 1 |

Additional variants with improved relative specificity to novel PBI-3939 were generated as described previously by saturating amino acid positions 18, 68, 72, 75, and 90 in variant 9B8. E. coli lysates were prepared and analyzed for brightness as described previously using native coelenterazine and novel PBI-3939 as substrates. Relative specificity was determined from the ratio of the luminescence of the variant with PBI-3939 to the luminescence of the variant with native coelenterazine, normalized to the ratio of corresponding luminescence of 9B8. Table 8 lists 9B8 variants ("Variant") with at least 1.1× fold-increase in relative specificity for PBI-3939. The results demonstrate that at least one additional change at each of the sites provided improved relative specificity for PBI-3939 versus native coelenterazine. 9B8 variants with amino acid substitutions K, D, F, G, Y, W, and H at position 18 had the highest fold improvement in relative specificity.

TABLE 8

Variants with Improved Relative Specificity for PBI-3939

| Variant | Relative specificity (PBI-3939 RLU/native coelenterazine RLU; normalized to 9B8) |
| --- | --- |
| 9B8 + L18K | 40.7 |
| 9B8 + L18D | 25.8 |
| 9B8 + L18F | 25.6 |
| 9B8 + L18G | 18.2 |
| 9B8 + L18Y | 17.8 |
| 9B8 + L18W | 11.2 |
| 9B8 + L18H | 9.1 |
| 9B8 + L18R | 3.5 |

TABLE 8-continued

Variants with Improved Relative Specificity for PBI-3939

| Variant | Relative specificity (PBI-3939 RLU/native coelenterazine RLU; normalized to 9B8) |
|---|---|
| 9B8 + L18M | 3.4 |
| 9B8 + L18N | 2.9 |
| 9B8 + L18P | 2.6 |
| 9B8 + L18S | 2.3 |
| 9B8 + Y68W | 1.1 |
| 9B8 + Q72W | 6.1 |
| 9B8 + Q72Y | 2.5 |
| 9B8 + Q72F | 2.2 |
| 9B8 + Q72V | 2.2 |
| 9B8 + Q72I | 2.1 |
| 9B8 + Q72T | 1.9 |
| 9B8 + Q72N | 1.8 |
| 9B8 + Q72R | 1.7 |
| 9B8 + Q72P | 1.6 |
| 9B8 + Q72G | 1.5 |
| 9B8 + Q72A | 1.4 |
| 9B8 + Q72M | 1.3 |
| 9B8 + Q72C | 1.3 |
| 9B8 + Q72H | 1.2 |
| 9B8 + Q72S | 1.2 |
| 9B8 + M75F | 1.2 |
| 9B8 + V90R | 2.4 |
| 9B8 + V90Y | 1.6 |
| 9B8 + V90D | 1.4 |
| 9B8 + V90P | 1.4 |
| 9B8 + V90K | 1.3 |
| 9B8 + V90Q | 1.2 |

G. 9B8+K33N Variants

An additional variant, 9B8 opt+K33N (SEQ ID NOs: 42 and 43) was generated to investigate the benefits of amino acid substitution K33N for brightness, relative specificity, and thermal stability. 9B8 opt+K33N was examined and compared to 9B8 opt (described in Example 25A) in various applications.

Figure 29:
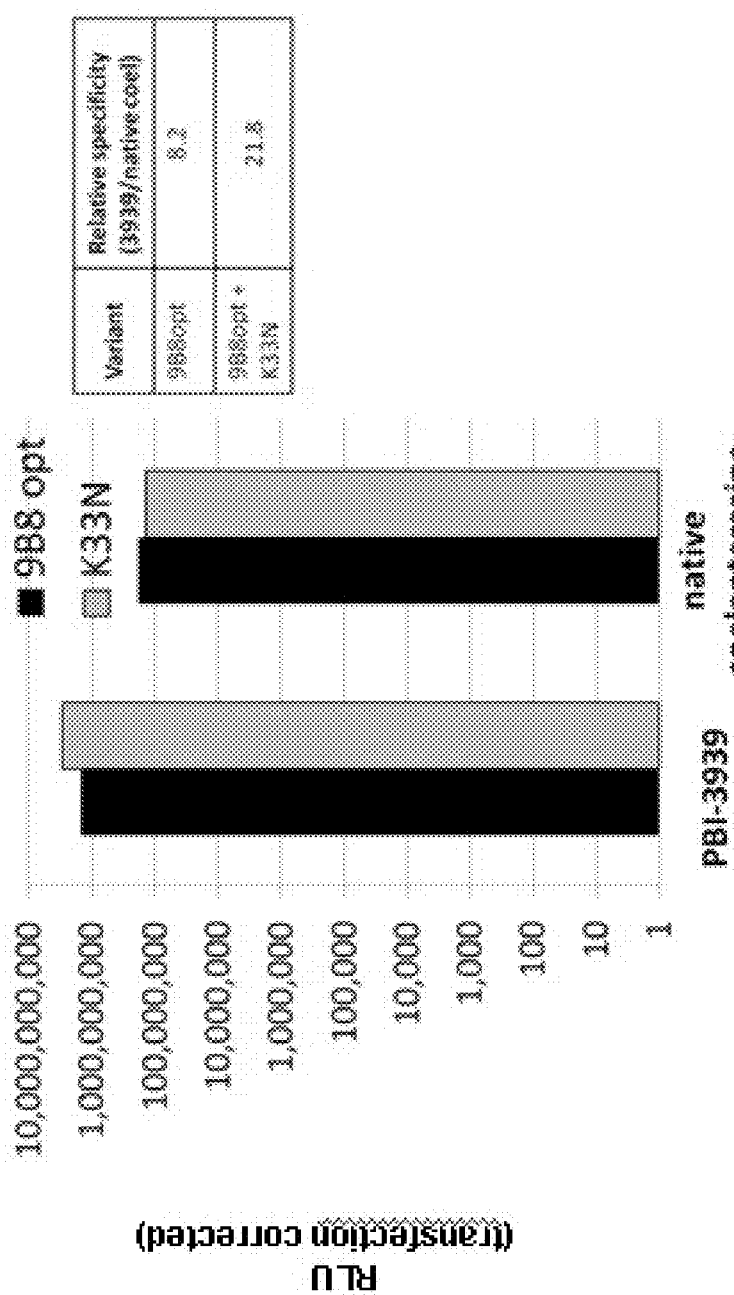
FIG. 29 shows the luminescence of 9B8 opt and 9B8 opt+K33N in bacterial lysates using native coelenterazine and PBI-3939 as substrates and the relative specificity of these variants for PBI-3939 compared to native coelenterazine.

E. coli lysates containing the variant 9B8 opt or 9B8 opt+K33N were prepared and analyzed as described previously except the assay buffer contained 0.1% TERGITOL® NP-9 (v/v). Luminescence generated from the lysates was measured using the novel PBI-3939 and native coelenterazine as substrates. The relative specificity of the variants for PBI-3939 and native coelenterazine was calculated as described previously. 9B8 opt+K33N ("K33N") had greater light output (RLU) and a higher relative specificity for PBI-3939 than native coelenterazine compared to 9B8 opt (FIG. 29), indicating that the K33N substitution provided greater light output and improved relative specificity.

A new OgLuc library was created using 9B8opt+K33N as a starting template. The random library was created using DIVERSIFY® PCR Random Mutagenesis Kit (ClonTech; Catalog #630703). Condition 5 (as listed in the user manual) was used to generate additional variants, and the average mutation rate was calculated to be 2.6 mutations per gene by compiling sequence data from 83 randomly selected clones. This PCR library was cloned into the pF4Ag-based, non-fusion vector background described previously and the sandwich background, i.e., Id-OgLuc-HT7 (described in Example 45). Variants in the pF4Ag-base non-fusion vector background are designated with (NF). Variants in the sandwich vector background are designated with (F). In order to clone the PCR product into both vectors, an amino acid, i.e., a glycine, was appended to the variant sequence in pF4Ag, generating a new position 170 in the OgLuc variant ("170G"). The 170G is present in the sandwich construct, but in this case is considered part of the linker between OgLuc and HT7. For each library, 4,400 E. coli clones were assayed as described previously with the following exceptions. The lysis buffer contained 300 mM MES pH 6.0 instead of HEPES, and 0.5% TERGITOL® NP-9 (v/v), but did not contain thiourea. The assay buffer contained 100 mM MES pH 6.0 instead of HEPES, and 35 mM thiourea. The assay volumes were as follows: 10 µL cells, 40 µL lysis buffer, and 50 µL assay buffer.

The PCR library in the pF4Ag-based non-fusion background was screened for additional variants with increased luminescence compared to 9B8 opt+K33N+170G (SEQ ID NOs: 68 and 69). Selected variants were then assayed in HEK293 and NIH3T3 cells. For each cell type, 15,000 cells were plated and grown overnight at 37° C. The next day, the cells were transfected as described in Example 25 with 10 ng pGL4.13 (Promega Corp.) as a transfection control and 100 ng of the OgLuc test DNA. The media was removed, and the cells were lysed with 100 µL of lysis buffer as described in Example 25 except the lysis buffer contained 100 mM MES pH 6.0 instead of HEPES, and luminescence measured using a GLOMAX® Luminometer. For each sample, 10 µL of lysate was assayed with 50 µL of lysis buffer containing 20 µM PBI-3939. For the transfection control, 10 µL of lysate was assayed with 50 µL of BRIGHT-GLO™ Assay Reagent.

Table 9 shows the fold-increase in luminescence of variants in E. coli, HEK293, and NIH3T3 cells and the amino acid substitutions found in the variants. The variants 27A5 (NF) (SEQ ID NOs: 70 and 71), 23D4 (NF) (SEQ ID NOs: 72 and 73) and 24C2 (NF) (SEQ ID NOs: 74 and 75) had at least 1.3 fold-increase in luminescence in E. coli and HEK293 cells.

TABLE 9

Increase in Luminescence Generated by OgLuc Variants Compared to 9B8 opt + K33N + 170G in E. coli, HEK293 and NIH3T3 Cells

| Sample | Sequence | Fold over 9B8 opt + K33N + 170G | | |
|---|---|---|---|---|
| | | E. coli | HEK293 | NIH3T3 |
| 27A5 (NF) | T39T, 170G | 1.3 | 1.5 | 1.3 |
| 23D4 (NF) | G26G, M106L, R112R, 170G | 1.5 | 1.6 | 1.2 |
| 24C2 (NF) | R11Q, T39T, 170G | 1.5 | 1.5 | 1.1 |

Based on the above data, further combination variants were designed and generated (see Table 10) in the context of the pF4Ag-based non-fusion vector background without the 170G. The variants were analyzed in E. coli, HEK293 and NIH3T3 cells as described above and compared to 9B8 opt+K33N. The variants were also examined for luminescence with native coelenterazine. Table 10 shows the fold-increase in luminescence of the variants in E. coli, HEK293, and NIH3T3 cells, and the amino acid substitutions found in the variants ("Sample"). The variants were named by adding the additional amino acid substitutions in the variant to the prefix "9B8 opt+K33N." Table 11 shows the relative specificity of the different variants for PBI-3939 compared to native coelenterazine in E. coli, NIH3T3, and HEK293 cells. As shown in Table 10, the variant 9B8 opt+K33N+T39T+K43R+Y68D ("V2"; SEQ ID NOs: 92 and 93) had improved luminescence in E. coli and a slight improvement in luminescence in NIH3T3 cells. The variant 9B8 opt+K33N+L27V+K43R+Y68D ("L27V, K43R, Y68D") had a neutral improvement in luminescence (Table 10) and 5× fold-increase in relative specificity over 9B8 opt+K33N (Table 11) in the three cell types examined.

TABLE 10

Increase in Luminescence Generated by OgLuc Combination Variants Compared to 9B8 opt + K33N in E. coli, NIH3T3 and HEK293 Cells

| Sample | Fold over 9B8 opt + K33N | | |
|---|---|---|---|
| | E. coli | NIH3T3 | HEK293 |
| T39T | 1.8 | 1.1 | 1.1 |
| K43R | 1.2 | 1.1 | 1.1 |
| T39T, K43R | 1.3 | 0.9 | 1.1 |
| Y68D | 1.0 | 1.0 | 1.2 |
| K43R, Y68D | 1.2 | 1.2 | 1.2 |
| T39T, K43R, Y68D ("V2") | 1.8 | 1.1 | 1.3 |
| L27V | 0.9 | 0.7 | 0.8 |
| L27V, K43R | 0.7 | 0.6 | 0.6 |
| L27V, K43R, Y68D | 1.2 | 0.8 | 0.9 |
| L27V, Y68D | 1.2 | 0.8 | 0.7 |
| S66N, K43R | 0.9 | 1.1 | 1.1 |
| L27V, K43R, S66N | 1.0 | 0.6 | 0.7 |
| 9B8 opt + K33N | 1.0 | 1.0 | 1.0 |

TABLE 11

Change in Relative Specificity of OgLuc Combination Variants for PBI-3939 Compared to Native Coelenterazine in E. coli, NIH3T3 and HEK293 Cells

| Sample | Fold over Native Coelenterazine | | |
|---|---|---|---|
| | E. coli | NIH3T3 | HEK293 |
| T39T | 18.2 | 18 | 20 |
| K43R | 29.5 | 31 | 32 |
| T39T, K43R | 29.4 | 30 | 32 |
| Y68D | 11.4 | 10 | 12 |
| K43R, Y68D | 18.6 | 19 | 21 |
| T39T, K43R, Y68D ("V2") | 18.5 | 18 | 21 |
| L27V | 85.2 | 85 | 97 |
| L27V, K43R | 120.1 | 131 | 147 |
| L27V, K43R, Y68D | 98.3 | 98 | 101 |
| L27V, Y68D | 59.9 | 61 | 64 |
| S66N, K43R | 22.9 | 23 | 25 |
| L27V, K43R, S66N | 100.4 | 97 | 106 |
| 9B8 opt + K33N | 19.0 | 19 | 19 |

Additional OgLuc variants were generated from 9B8 opt+K33N to contain at least one of the following additional amino acid substitutions relative to SEQ ID NO: 1: L27V, T39T, K43R, Y68D, or S66N (see "Sample" in Table 12 for the amino acid substitutions in the variants). The variants were named by adding the additional amino acid substitutions in the variant after the prefix "9B8 opt+K33N." These additional variants and the variants 9B8 opt+K33N+L27V+ Y68D ("L27V, Y68D"), 9B8 opt+K33N+L27V+K43R+ Y68D ("L27V, K43R, Y68D"), 9B8 opt+K33N+L27V+ K43R+S66N ("L27V, K43R, S66N"), and 9B8 opt+K33N+ T39T+K43R+Y68D ("T39T, K43R, Y68D"; also known as "V2") from above, were examined for brightness, relative specificity, signal stability and thermal stability. The variants were compared to the variants 9B8 opt ("9B8") and 9B8 opt+K33N ("K33N").

E. coli lysates containing the variants were prepared and analyzed as described previously. Luminescence generated from the lysates was measured using the novel PBI-3939 and native coelenterazine as substrates. The luminescence of the variants was normalized to the luminescence generated by 9B8 opt (Table 12). The relative specificity of the variants for PBI-3939 and native coelenterazine was calculated by dividing the luminescence of the variants using PBI-3939 as a substrate with the luminescence of the variants using native coelenterazine as a substrate (Table 12). This data indicates that the amino acid substitution L27V lowers specificity for native coelenterazine.

TABLE 12

Increase in Luminescence Generated by OgLuc Variants Compared to 9B8 and Change in Specificity of OgLuc Variants for PBI-3939 Compared to Native Coelenterazine in Bacterial Lysates

| Sample | Fold over 9B8 | Fold over coelenterazine |
|---|---|---|
| 9B8 | 1.0 | 7 |
| K33N | 1.1 | 21 |
| T39T, Y68D | 0.9 | 12 |
| T39T, L27V, K43R | 1.2 | 149 |
| L27V, T39T, K43R, Y68D | 1.8 | 110 |
| T39T, K43R, Y68D | 1.6 | 21 |
| L27V, T39T, K43R, S66N | 1.3 | 114 |
| L27V, K43R, Y68D | 1.3 | 110 |
| L27V, Y68D | 1.0 | 63 |
| L27V, K43R, S66N | 1.1 | 114 |

H. V2 Variants

A set of additional variants were designed using V2 (9B8opt with the additional amino acid substitutions K33N+ T39T+K43R+Y68D) as a template. The substitutions shown in Table 13 were designed based on either 1) the known diversity according to the structure-based alignment of 28 fatty acid binding proteins (1VYF, 1FDQ, 2A0A, 1O8V, 1BWY, 2ANS, 1VIV, 1PMP, 1FTP, 2HNX, 1JJJ, 1CBR, 2CBS, 1LPJ, 1KQW, 2RCQ, 1EII, 1CRB, 1IFC, 2PYI, 2JU3, 1MVG, 2QO4, 1P6P, 2FT9, 1MDC, 1O1U, 1EIO; See U.S. Published Application No. 2010/0281552), or 2) the probing of alternative residues at positions previously identified to play a role in substrate specificity. Changes listed under "Consensus" in Table 13 relate to residues identified in at least 50% of the aligned, above-mentioned fatty acid binding proteins. Changes listed under "Predominant Minority" relate to residues identified in many of the fatty acid binding proteins mentioned above, but found in fewer than 50% of the aligned sequences. Changes listed under "Other" relate to residues were identified less frequently than the predominant minority residue at a given position in the aligned sequences. Finally, changes listed under "Specificity" relate to positions suspected to be involved in determining a variant's specificity for coelenterazine or a coelenterazine analog. For example, the designed specificity changes at position 27 (leucine residue in the parental sequence, i.e., V2) were changed to other hydrophobic residues or amino acids representing alternative chemistries (e.g., other hydrophobic residues containing rings, residues containing uncharged polar side chains, or residues containing charged side chains); and the designed specificity changes at position 40 (proline in the parental sequence), were to a sampling of different chemistries (chemistries (e.g., other hydrophobic residues containing rings, residues containing uncharged polar side chains, or residues containing charged side chains); note that glycine, glutamine, isoleucine, and leucine are identified at this position the aligned fatty acid binding proteins).

TABLE 13

| Consensus | Predominant minority | Other | Specificity |
|---|---|---|---|
| 9 T | 9 K | 9 R | 27 A, I, M, G, D |
| 14 S | 10 Y | 40 G | 40 T, S, F, D, Y |
| 16 E | 23 R | | |
| 22 M | 32 I | | |
| 23 K | 63 T | | |
| 24 A | 87 T | | |
| 25 L | 100 I | | |
| 32 R | 111 N, D | | |
| 35 A | 118 I | | |
| 39 K | 134 K | | |
| 46 Q | 142 K, W | | |
| 57 F | 147 N | | |
| 63 S | 149 M | | |
| 87 N | 152 E | | |
| 97 E | 162 Q | | |
| 98 F | | | |
| 100 E | | | |
| 102 T | | | |
| 110 D | | | |
| 113 K | | | |
| 118 V | | | |
| 125 L | | | |
| 126 V | | | |
| 129 Q | | | |
| 130 K | | | |
| 142 E | | | |
| 146 G | | | |
| 147 D | | | |
| 150 V | | | |
| 152 T | | | |
| 165 K | | | |

The variants were constructed using standard site-directed mutagenesis protocols (see previous examples), and the resulting plasmids transformed into E. coli for analysis. Cultures were grown per standard walk away induction in minimal media as described previously. To 10 μL of the cultured, transformed E. coli cells, 40 μL of lysis buffer (100 mM MES pH 6.0, 0.3×PLB, 0.3 mg/mL Lysozyme, 0.003 U/μL RQ1 DNaseI and 0.25% TERGITOL® NP-9 (v/v)) was added followed by the additional of an equal volume (50 μL) of assay reagent (1 mM CDTA, 150 mM KCl, 2 mM DTT, 20 μM PBI-3939 or native coelenterazine, 100 mM MES pH 6.0, 35 mM thiourea, and 0.5% TERGITOL® NP-9 (v/v)). Luminescence was measured on a GLOMAX® 96 Microplate Luminometer (Promega Corp.).

Table 14 summarizes the different amino acid substitutions identified in the analysis. The data is presented as normalized to the parental clone (V2) with regards to the luminescence measured for both PBI-3939 and native coelenterazine. The relative change in specificity to PBI-3939 with respect to native coelenterazine is also shown.

TABLE 14

| Substitution | PBI-3939 NORMALIZED | COELENTERAZINE NORMALIZED | RELATIVE CHANGE IN SPECIFICITY FOR PBI-3939 |
|---|---|---|---|
| 10 Y | 0.7 | 0.2 | 3.5 |
| 14 S | 1.3 | 1.2 | 1.1 |
| 16 E | 0.5 | 0.2 | 2.5 |
| 23 K | 1.3 | 4 | 0.3 |
| 24 A | 0.4 | 0.2 | 2.0 |
| 25 L | 0.0001 | 0.000023 | 4.3 |
| 27 A | 0.8 | 0.1 | 8.0 |
| 27 D | 0.006 | 0.001 | 6.0 |
| 27 G | 0.088 | 0.005 | 17.6 |
| 27 I | 0.2 | 0.024 | 8.3 |
| 27 M | 2.2 | 0.9 | 2.4 |
| 40 I | 0.0017 | 0.0002 | 8.5 |
| 40 L | 0.0007 | 0.0001 | 7.0 |
| 40 Q | 0.0001 | 0.000026 | 3.8 |
| 87 N | 1.2 | 1.5 | 0.8 |
| 87 T | 1.3 | 1.6 | 0.8 |
| 97 E | 0.014 | 0.01 | 1.4 |
| 100 I | 0.002 | 0.002 | 1.0 |
| 102 T | 1.1 | 1.1 | 1.0 |
| 111 N | 0.6 | 0.6 | 1.0 |
| 113 K | 1.2 | 0.6 | 2.0 |
| 125 L | 0.6 | 0.4 | 1.5 |
| 129 Q | 0.0003 | 0.0001 | 3.0 |
| 130 K | 1.1 | 0.9 | 1.2 |
| 142 E | 0.9 | 0.3 | 3.0 |
| 142 K | 0.9 | 0.3 | 3.0 |
| 142 W | 0.8 | 0.4 | 2.0 |
| 146 G | 0.9 | 0.8 | 1.1 |
| 147 N | 0.4 | 0.4 | 1.0 |
| 149 M | 0.7 | 0.4 | 1.8 |
| 150 V | 0.9 | 0.4 | 2.3 |
| 152 E | 0.9 | 0.5 | 1.8 |
| 152 T | 0.9 | 0.3 | 3.0 |

I. L27V Variants

Using the OgLuc variant L27V as a starting template, i.e., starting sequence or parental sequence, additional variants were made in which some of the amino acids (Table 15) in the L27V variant were reverted to the amino acids found in the native OgLuc luciferase of SEQ ID NO: 1. The variants were constructed by site-directed mutagenesis as previously described. The variants were then screened as previously described for relative activity with either native coelenterazine or PBI-3939. Luminescence was measured on a TECAN® INFINITE® F500 5 min after substrate/assay reagent (as described in H) was added and normalized to the L27V variant starting template. SDS-PAGE analysis of the lysates indicates comparable expression levels (data not shown).

Table 15 shows the relative activities of the L27V variants with native coelenterazine or PBI-3939. Relative activities <1 indicate the reversion is detrimental compared to the residue at that site in the L27V variant. Relative activities >1 indicate the reversion is favorable for activity compared to the residue at that site in the L27V variant. Some additional data on these mutants indicated the following: 166K, 54F, 54A and L27V were tested for thermal stability. The $T_{1/2}$ 60° C. for 166K, 54F, and 54A were 87, 74, and 33%, respectively, indicating these substitutions cause a reduction in thermal stability. The Km values for these same 4 variants were the following: for native coelenterazine, L27V was 16 μM, 54A was 23 μM, 54F was 40 μM, and 166K was 21 μM; for PBI-3939, L27V was 18 μM, 54A was 62 μM, 54F was 163 μM, and 166K was 23 μM. This indicates higher substrate affinity for L27V, particularly for the position 54 substitutions.

TABLE 15

| Native coelenterazine (50 mM) | | PBI-3939 (50 mM) | |
|---|---|---|---|
| AA substitution | Relative activity (5 min) | AA substitution | Relative activity (5 min) |
| 72L | 0.2 | 72L | 0.6 |
| 4A | 1.0 | 4A | 1.0 |
| 124Q | 1.6 | 124Q | 1.0 |
| 43K | 1.9 | 43K | 1.1 |

TABLE 15-continued

| Native coelenterazine (50 mM) | | PBI-3939 (50 mM) | |
|---|---|---|---|
| AA substitution | Relative activity (5 min) | AA substitution | Relative activity (5 min) |
| 115P | 0.6 | 115P | 0.9 |
| 166N | 2 | 166N | 2.0 |
| 75M | 1.1 | 75M | 1.2 |
| 54F | 0.1 | 54F | 0.4 |
| 68F | 0.5 | 68F | 0.9 |
| 33A | 1.7 | 33A | 1.0 |
| 138Y | 1.0 | 138Y | 1.0 |
| 54A | 0.6 | 54A | 1.6 |
| 90I | 0.8 | 90I | 0.6 |
| 33K | 4.2 | 33K | 0.8 |
| 44V | 0.7 | 44V | 1 |
| 166K | 2.1 | 166K | 2 |
| 11Q | 1.6 | 11Q | 1.3 |
| 166F | 0.3 | 166F | 0.4 |
| 18Q | 4.1 | 18Q | 0.6 |

Example 23—Mutational Analysis of Position 166

A. To assess the effect of different amino acids at position 166 on the luciferase activity, the arginine (R) residue at position 166 was substituted to each of the other 19 amino acids using site-directed mutagenesis as previously described in the context of a pF4Ag vector (i.e., in the context of the wild-type OgLuc sequence SEQ ID NO: 1). These position 166 variants were then expressed in E. coli as previously described.

To create lysates, 50 µL 0.5× FASTBREAK™ Cell Lysis Reagent (Promega Corp.) was added to 950 µl of induced cultures, and the mixtures incubated for 30 min at 22° C. For the analysis, 50 µL of lysate was assayed in 50 µL of assay reagent (as previously described in Example 22H) with either 100 µM PBI-3939, 30 µM native coelenterazine, or 22 µM coelenterazine-h). Luminescence was measured as previously described (FIGS. 30A-C). FIGS. 30A-C show the relative activity of the N166 mutants. Western analysis confirmed comparable expression of all variants (data not shown).

B. The specific single amino acid substitutions, L27V, A33N, K43R, M75K, T39T, L72Q and F68D were assessed in the wild-type OgLuc or N166R background. The single amino acid substitutions were generated via site-directed mutagenesis as previously described, expressed in E. coli as previously described, and luminescence measured using the assay reagent (previously described in Example 22H) with 22 µM native coelenterazine (FIG. 30D). Western analysis confirmed comparable expression of all variants (data not shown).

Example 24—Deletion Variants

Deletions to the L27V variant were made as follows:

TABLE 16

| Deletion # | Deletion Made |
|---|---|
| 27 | Residues 1-27 and Val-1 |
| 52 | Residues 1-52 and Val-1 |
| 64 | Residues 1-64 and Val-1 |
| 84 | Residues 1-84 and Val-1 |
| 19 | Residues 65-83 |
| 23 | Residues 65-87 |
| 23A1 | Residues 65-87 + G64D |

Figure 31:
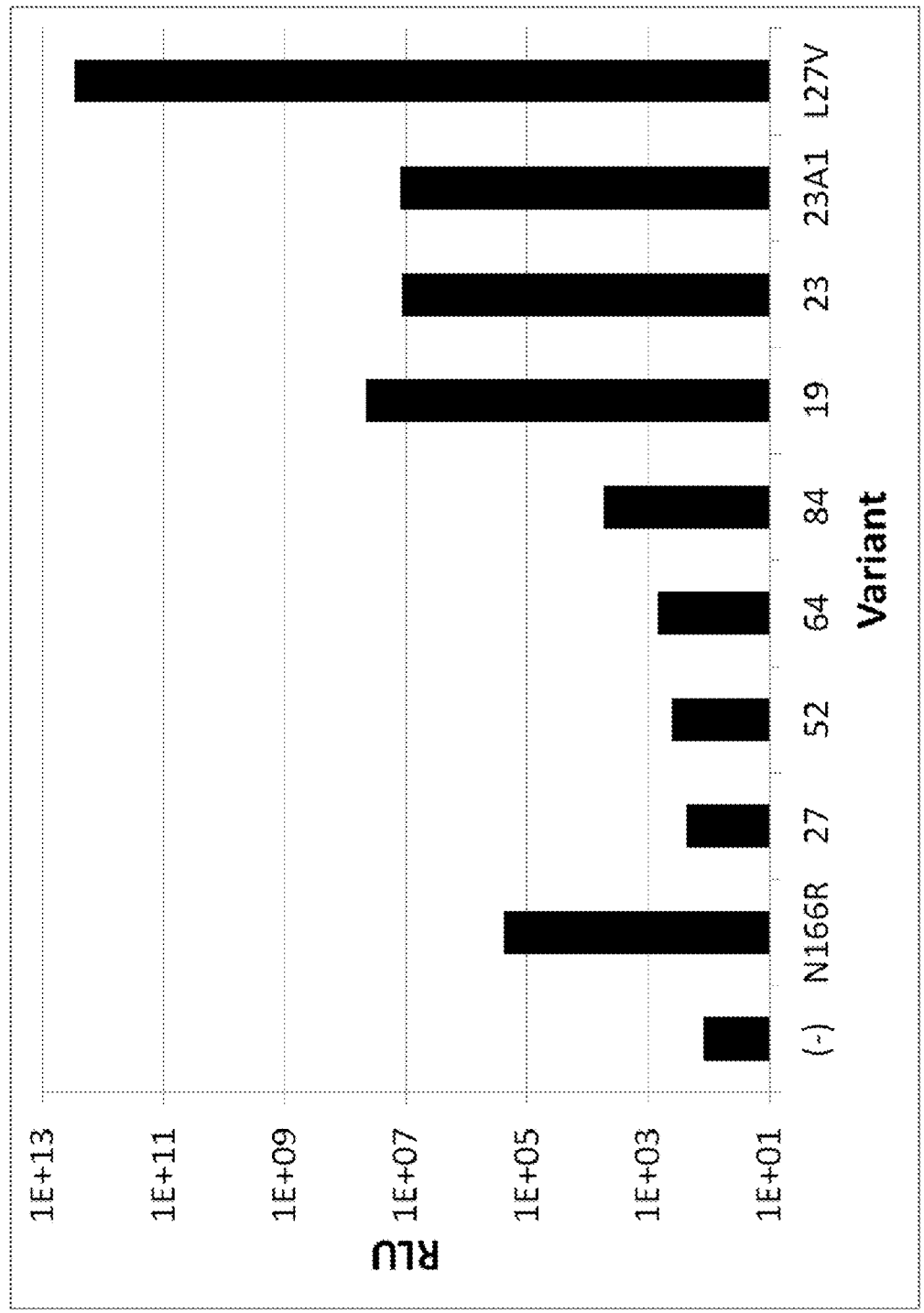
FIG. 31 shows the luminescence of various deletions in the OgLuc variant L27V where (−) is the machine background.

The N-terminus of the OgLuc variant L27V is methionine, valine and phenylalanine, i.e., MVF. For numbering purposes, the phenylalanine was considered the first amino acid. "Val-1" indicates that the Valine in "MVF" was deleted. The methionine of "MVF" was included in these deletions. The L27 deletion variants were cloned in the pF4Ag vector and expressed in E. coli KRX cells as previously described. Inductions and lysate preparations were performed as described Lysates were analyzed using the assay reagent (previously described; 100 µM PBI-3939), and luminescence measured as previously described (FIG. 31). The data demonstrates that smaller fragments of the OgLuc variants can also generate luminescence.

Example 25—Codon Optimization of OgLuc Variants

A. IV and 9B8

The IV and 9B8 OgLuc variants were used as templates for codon optimization. The goals, as understood by those skilled in the art, were two-fold: 1) to remove known transcription factor binding sites, or other regulatory sequences, e.g., promoter modules, splice donor/acceptor sites, splice silencers, Kozak sequences, and poly-A signals, that could potentially interfere with the regulation or expression of the OgLuc variants, and 2) to alter the DNA sequence (via silent mutations that do not alter protein sequence) to eliminate rarely used codons, and favor the most commonly used codons in cells of E. coli, human, other mammalian, or other eukaryotic organisms (Wada et al., Nucleic Acids Res., 18:2367 (1990)).

Two different optimized sequences for IV and 9B8, referred to as opt (aka optA) and optB, were designed for each variant. The first optimized sequence, i.e., opt/optA for each variant, was designed by identifying the two best, i.e., most common, human codons for each site (see Table 17) and then randomly picking one of the two for incorporation at each site. For the optB versions, the previous, codon-usage, optimized version, i.e., opt/optA, was used as a starting template, and each codon replaced with the other of the two best human codons identified for this codon-optimization strategy. As an example, the leucine at position 3 in either the IV or 9B8 sequence is encoded by the codon TTG. TTG is not one of the two most common codons for leucine in a human cell, and therefore the codon was changed to the alternative, more common codons for leucine, CTC (opt/optA) or CTG (optB). This same process was repeated for all leucines in the sequence, and due to the random nature of the approach, a CTC codon could end up in optB and the CTG could end up in optA. Because of this two codon-usage approach to optimization, sequences opt/optA and opt B were maximally codon-distinct.

TABLE 17

| Codons used in Codon Optimization | | |
|---|---|---|
| Amino acid | Choice#1 | Choice#2 |
| Gly | GGC | GGG |
| Glu | GAG | GAA |
| Asp | GAC | GAT |
| Val | GTG | GTC |
| Ala | GCC | GCT |

TABLE 17-continued

Codons used in Codon Optimization

| Amino acid | Choice#1 | Choice#2 |
|---|---|---|
| Ser | AGC | TTC |
| Lys | AAG | AAA |
| Asn | AAC | AAT |
| Met | ATG | |
| Ile | ATC | ATT |
| Thr | ACC | ACA |
| Trp | TGG | |
| Cys | TGC | TGT |
| Tyr | TAC | TAT |
| Phe | TTC | TTT |
| Arg | CGG | CGC |
| Gln | CAG | CAA |
| His | CAC | CAT |
| Leu | CTG | CTC |
| Pro | CCC | CCT |

Each of the 4 sequences (IV opt, IV optB; 9B8 opt, 9B8 optB) were then analyzed (Genomatix Software, Germany) for the presence of transcription factor binding sites or other regulatory sequences as described above, and these undesirable sequences were disrupted via silent nucleotide changes. In some cases, where there were other non-rare codons for both human and *E. coli*, the transcription factor binding sites or other regulatory elements was removed by changing to one of these codons, even though they are not choice#1 or choice#2 (see Table 18). In cases, where removing a transcription factor binding site or other regulatory element would have involved introducing a rare codon, the transcription binding site (or other regulatory element) was usually not changed.

TABLE 18

Additional Codons used to Remove Transcription Factor Binding Sites and Other Regulatory Elements

| Amino Acid | Choice #3 | Choice #4 |
|---|---|---|
| Gly | GGA | GGT |
| Val | GTA | GTT |
| Ala | GCG | GCA |
| Ser | AGT | TCA |
| Thr | ACG | ACT |
| Leu | TTG | CTT |
| Pro | CCG | CCA |

Codon optimized versions of IV ("IV opt" (SEQ ID NO: 22) and "IV optB" (SEQ ID NO: 23)) and 9B8 ("9B8 opt" (SEQ ID NO: 24) and "9B8 optB" (SEQ ID NO: 25)) were generated and cloned into pF4Ag by methods known in the art. HEK293 cells were plated in 96-well plates at 15,000 cells/well and grown overnight at 37° C. The following day, the cells were transiently transfected in 6 well replicates using TRANSIT®-LT1 Transfection Reagent (Mirus Bio) with 100 ng of plasmid DNA encoding the codon optimized versions in pF4Ag and grown overnight at 37° C. HEK293 cells were also transfected with either pGL4.13 (Luc2/SV40) (Paguio et al., "pGL4 Vectors: A New Generation of Luciferase Reporter Vectors" *Promega Notes*, 89:7-10 (2005)) or pGL4.73 (hRL/SV40) (Id.) to normalize for differences in transfection efficiency. Ten ng/transfection or 10% of the total DNA transfected was used. Media was removed, and cells were lysed with 100 µL lysis buffer which contained 10 mM CDTA, 150 mM KCl, 10 mM DTT, 100 mM HEPES, pH 7.0, 35 mM thiourea, and 0.5% TERGITOL® NP-9 (v/v) to create a lysate sample. Luminescence of the lysate sample was measured on a TECAN® INFINITE® F500 luminometer as follows: for hRL and the OgLuc variants, 10 µL of the lysate sample was assayed for luminescence with 50 µL of lysis buffer containing 20 µM of substrate (native coelenterazine for hRL and PBI-3939 for the OgLuc variants). For Luc2 (SEQ ID NOs: 28 and 29), a firefly luciferase, 10 µL of lysate sample was assayed for luminescence with 50 µL of BRIGHT-GLO™ Luciferase Assay Reagent (Promega Corp.).

Figure 32:
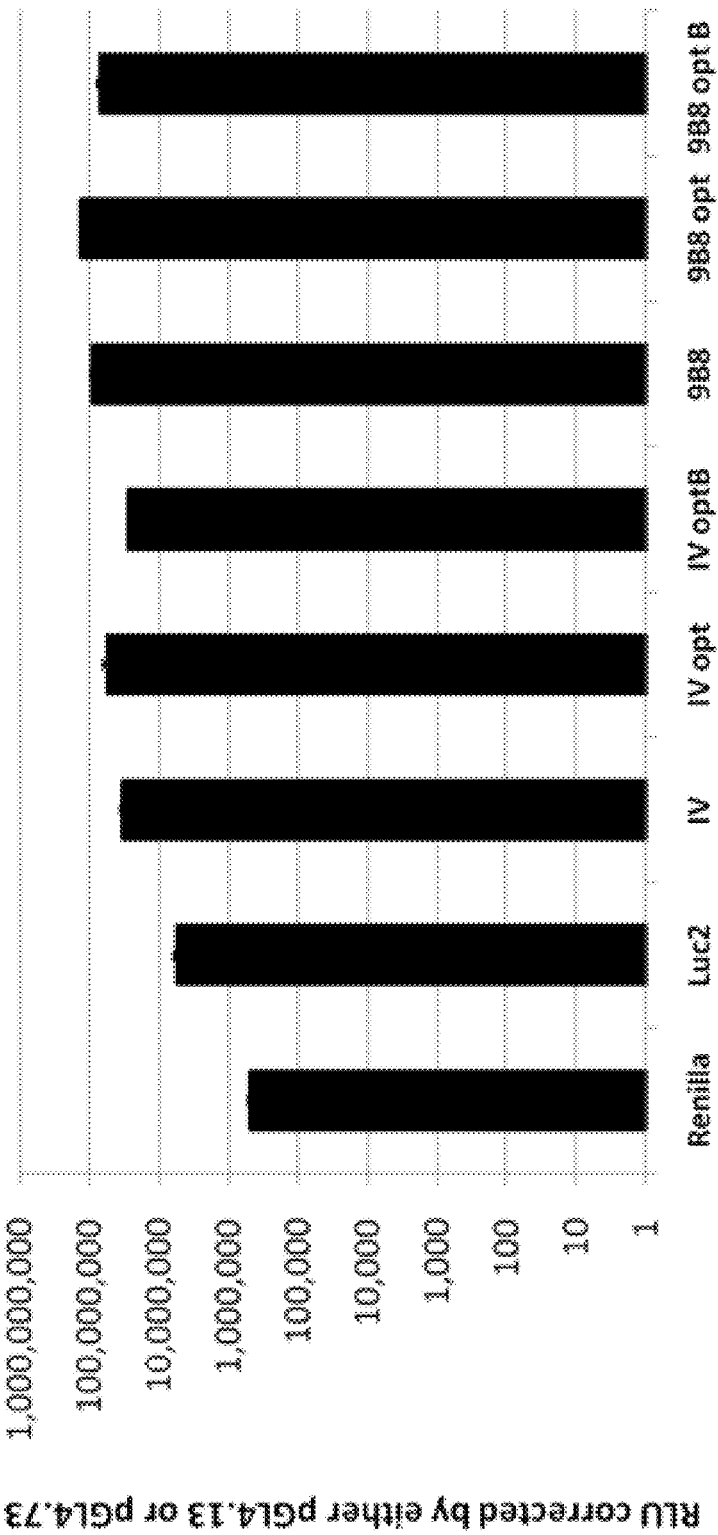
FIG. 32 shows the normalized luminescence generated from lysed HEK293 cells expressing hRL ("Renilla") using native coelenterazine as a substrate, firefly luciferase (Luc2) using luciferin (BRIGHT-GLO™ Assay Reagent) as a substrate, and various OgLuc variants using novel PBI-3939 as a substrate.

FIG. 32 shows a comparison of the luminescence measured for the lysates containing the codon optimized versions of the OgLuc variants compared to hRL and Luc2. hRL and the OgLuc variants were normalized to pGL4.13 and Luc2 was normalized to pGL4.73 using methods known in the art. As shown in FIG. 32, Luc2 had approximately 14 fold higher luminescence than hRL. The OgLuc variants had higher luminescence compared to Luc2 and hRL. The codon optimized versions of IV ("IV opt" and "IV optB") and 9B8 ("9B8 opt") showed increased luminescence compared to the non-optimized versions.

As a result of this optimization, the "opt/optA" versions expressed better in human HEK293 cells than their parental sequence, while the "optB" versions did not express as well in HEK293 cells compared to the parental sequence.

B. L27V

The L27V variant (SEQ ID NO: 88) was optimized to minimize the occurrence of common vertebrate response elements (any transcription factor binding site (TFBS) in the Genomatix database). Three different optimized versions of the L27V variant were created:

1. L27V01—version 1 (SEQ ID NO: 319)—Promoter modules and all other undesired sequence elements (additional details below) were removed by nucleotide substitutions except for individual TFBSs.

2. L27V02—version 2-L27V01 was used as the starting, i.e., parental, sequence, and as many TFBSs were removed as possible using high stringency match criteria (A higher stringency involves a better match to the binding site and will thus find fewer matches than a lower stringency). There were two versions, A (SEQ ID NO: 322) & B ((SEQ ID NO: 318)), created for L27V02. These two versions were created by selecting different codons for each version to remove undesired sequence elements. Both versions were analyzed by searching for TFBSs with lower stringency.

3. L27V03—version 3 (SEQ ID NO: 325)—L27V02B (SEQ ID NO: 318) was used as the starting sequence. Lower stringency TFBS matches were removed where possible. L27V03 was created to be very codon distinct from L27V02A.

The following criteria were used to create the L27V optimized variants:

1. Codon usage: Preferably, the best two human codons were used for each amino acid (as was done for the IV variant), and the use of rare human codons (HS; coding for <10% of amino acids) was avoided (Table 19). The use of rare *E. coli* codons (EC) was used, if necessary, to remove undesired sequence elements.

TABLE 19

| Amino acid | Best Codons | Avoid Codons |
|---|---|---|
| A | GCT | |
| A | GCC | |
| C | TGT | |
| C | TGC | |
| D | GAT | |
| D | GAC | |
| E | GAG | |
| E | GAA | |
| F | TTT | |
| F | TTC | |
| G | GGG | |
| G | GGC | |
| H | CAT | |
| H | CAC | |
| I | ATT | ATA [EC] |
| I | ATC | |
| K | AAG | |
| K | AAA | |
| L | CTG | TTA [HS] |
| L | CTC | CTA [HS, EC] |
| M | ATG | |
| N | AAT | |
| N | AAC | |
| P | CCT | |
| P | CCC | |
| Q | CAG | |
| Q | CAA | |
| R | CGG | AGG [EC] AGA [EC] |
| R | CGC | CGA [EC] CGT [HS] |
| S | AGC | TCG [HS] |
| S | TCC | |
| T | ACA | |
| T | ACC | |
| V | GTG | |
| V | GTC | |
| W | TGG | |
| Y | TAT | |
| Y | TAC | |

2. Undesired Sequence Elements that were Removed where Possible

A. Restriction Enzyme (RE) Sites: RE sites were removed that would be useful for cloning and should otherwise not be present in open reading frame (ORF).

B. Eukaryotic Sequence Elements: Splice donor and acceptor sites, splice silencers, Kozak sequence and PolyA sequences in the (+) mRNA strand were removed.

C. Vertebrate Promoter Modules (PM) (in Genomatix category: Vertebrate) were removed.

D. Vertebrate TFBS (in Genomatix categories: Vertebrate, general Core Promoter Elements, and miscellaneous other sequences) were removed where possible. This applied only to L27V optimized versions 2 and 3, but not to version 1.

E. *E. coli* Sequence Elements: *E. coli* promoters were removed.

F. mRNA Secondary Structure: Strong secondary structures (high mRNA folding energy) near the 5' end (Zuker, *Nucleic Acid Res.* 31(13): 3406-3415 (2003)) and other strong hairpin structures were removed.

A sequence comparison, percent pair-wise sequence identity is provided in Table 20 ("( )" indicate number of nucleotide differences).

TABLE 20

| | L27V01 | L27V02A | L27V02B | L27V03 |
|---|---|---|---|---|
| L27V00 | 99% (3) | 97% | 97% | 94% |
| L27V01 | | 98% (12) | 98% | 94% (32) |
| L27V02A | | | 99% (4) | 95% (26) |
| L27V02B | | | | 96% |

Example 26—Signal Stability of OgLuc Variants

A. 15C1, 9B and IV

The signal stability of 15C1 with PBI-3945 and 9B8 with PBI-3889 was measured and compared to IV. *E. coli* containing plasmid DNA encoding 15C1, 9B8, or IV were grown and induced as described previously in 8-well replicates. Cells were lysed using a lysis buffer containing of 300 mM HEPES pH 8.0, 0.3× Passive Lysis Buffer ("PLB"; Promega Corp. Cat. No. E194A), 0.3 mg/mL lysozyme, and 0.003 U/μL RQ1 DNase. Lysates were diluted 1:1000 in lysis buffer and measured for luminescence using a TECAN® INFINITE® F500 luminometer. Measurements were taken immediately after the addition to 10 μL of diluted lysate sample of 50 μL of "Glo" 0.5% TERGITOL assay buffer ("0.5% TERGITOL"), which contained 150 mM KCl, 1 mM CDTA, 10 mM DTT, 100 mM thiourea, 0.5% TERGITOL® NP-9 (v/v), and 20 μM of either novel coelenterazines PBI-3945 or PBI 3889.

Figure 33:
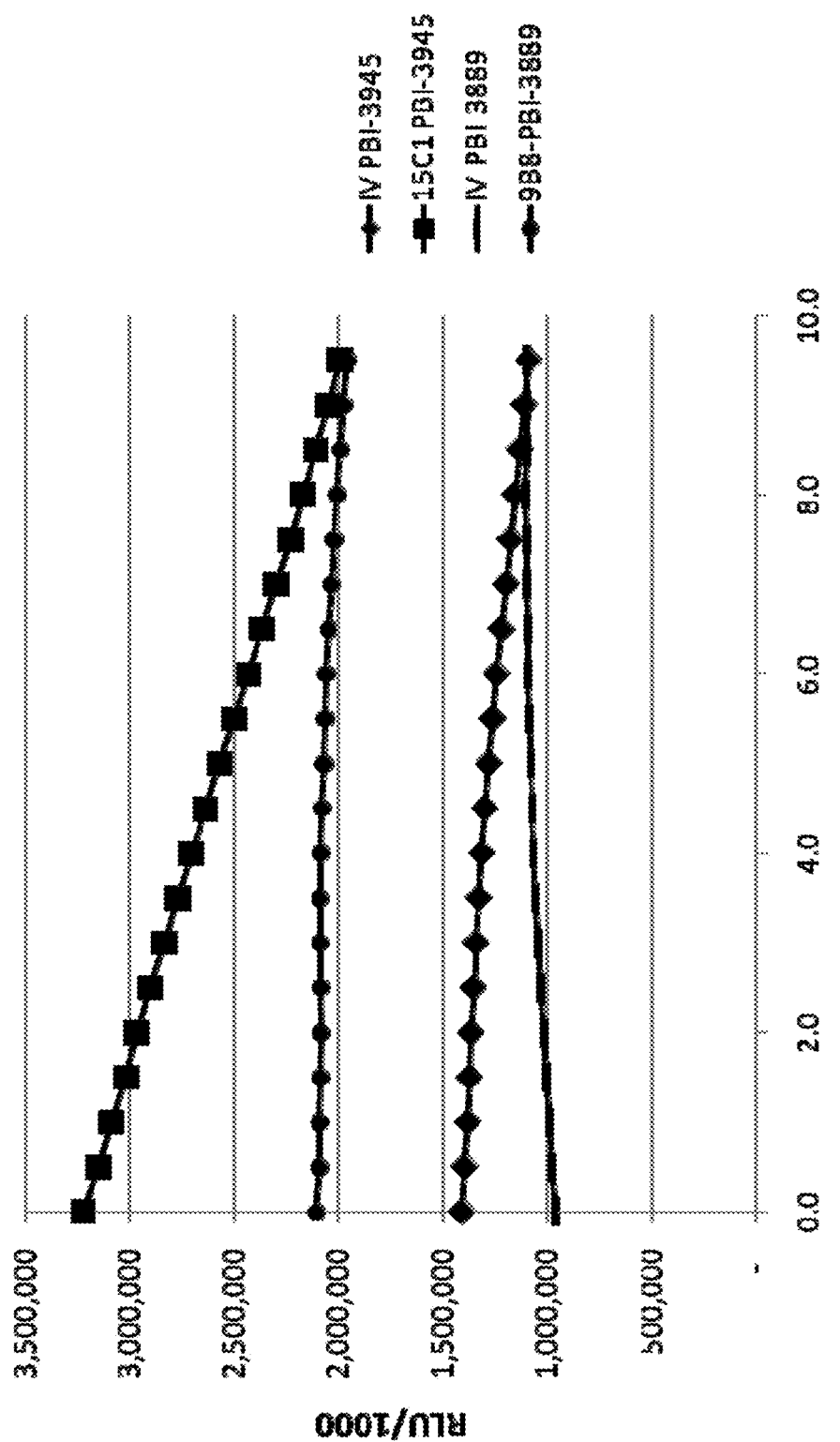
FIG. 33 shows the signal stability of IV and 15C1 in bacterial lysates using the novel coelenterazine PBI-3945 as a substrate and IV and 9B8 in bacterial lysates using the novel coelenterazine PBI-3889 as a substrate.

The signal stability of the variants was determined by re-reading the plate every 30 seconds for a length of time after the addition of the assay buffer to the sample. The signal half-life was determined from these measurements using methods known in the art. The average signal half-life was compared between the variants and IV. Both 15C1 and 9B8 had a signal half-life of at least 30 min (FIG. 33). Although 15C1, assayed with PBI-3945 had a higher luminescence at t=0, the signal decayed more rapidly than variant 9B8 assayed with PBI-3889. At t=10 min, luminescence for 15C1 with PBI-3945 and 9B8 with PBI-3889 were equivalent.

B. 9B8 Opt+K33N

The signal stability of the 9B8 opt+K33N variants was examined *E. coli* lysates containing the variants were prepared and analyzed as described previously except the assay buffer contained 0.25% TERGITOL® NP-9 (v/v), 100 mM MES pH 6.0, 1 mM CDTA, 150 mM KCl, 35 mM thiourea, 2 mM DTT, and 20 µM PBI-3939. Table 22 shows the signal half-life in min of the variants and indicates that the amino acid substitution L27V improves signal stability.

TABLE 22

Signal stability of OgLuc variants in bacterial lysates

| sample | signal half life (min) |
| --- | --- |
| 9B8 | 74 |
| K33N | 55 |
| T39T, Y68D | 87 |
| T39T, L27V, K43R | 139 |
| L27V, T39T, K43R, Y68D | 114 |
| T39T, K43R, Y68D | 61 |
| L27V, T39T, K43R, S66N | 124 |
| L27V, K43R, Y68D | 122 |
| L27V, Y68D | 139 |
| L27V, K43R, S66N | 124 |

Figure 34:
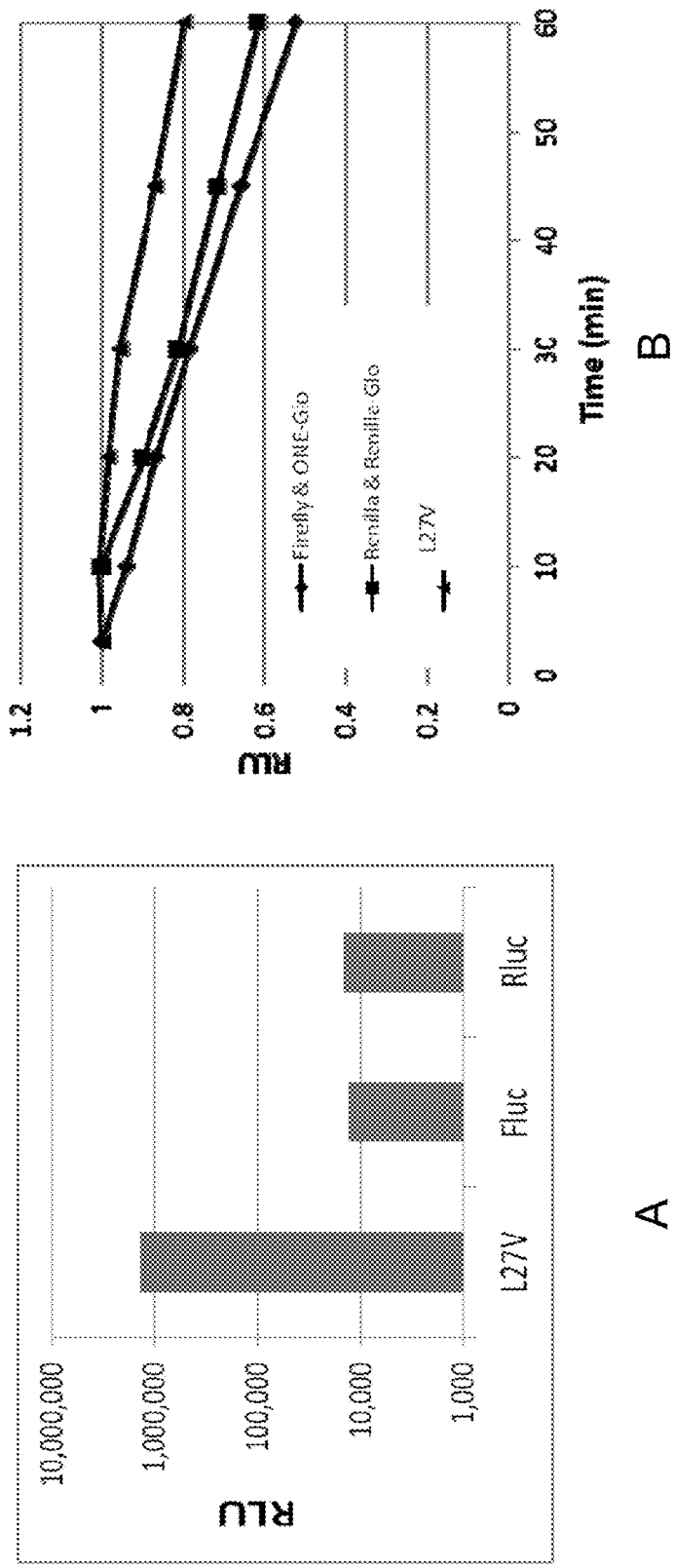
FIGS. 34A-B show the higher activity (FIG. 34A) and signal stability (FIG. 34B) of the OgLuc variant L27V compared to Firefly (Fluc) and Renilla (Rluc) luciferases.

The signal activity and stability of the L27V variant (9B8+K33N+L27V+T39T+K43R+Y68D; SEQ ID NO: 88 and 89) was measured and compared to that of firefly (Luc2) and *Renilla* luciferases. The L27V variant, Luc2 and *Renilla* luciferases were fused to HALOTAG® and expressed in *E. coli*. The luciferases were purified using HALOTAG® as a purification tag according to the manufacturer's protocol (pFN18A; HALOTAG® Protein Purification System). 10 PM of each purified luciferase (diluted in DMEM without phenol red containing 0.01% PRIONEX®) was then mixed with an equal volume of an assay reagent (100 mM MES pH 6, 35 mM thiourea, 0.5% TERGITOL® NP-9 (v/v), 1 mM CDTA, 2 mM DTT, 150 mM KCl, and 100 µM PBI-3939 for the L27V variant; ONE-GLO™ Luciferase Assay System (Promega Corp.) for firefly luciferase; and *RENILLA*-GLO™ Luciferase Assay System (Promega Corp.) for *Renilla* luciferase), and luminescence was monitored over time (3, 10, 20, 30, 45 and 60 min). FIGS. 34A-B demonstrates the high specific activity (FIG. 34A) and signal stability (FIG. 34B) of the L27V variant when compared to firefly and *Renilla* luciferase.

Example 27—Enzyme Kinetics of OgLuc Variants

A. IV, 15C1, 9B8, 9F6 and 9A3

Figure 35:
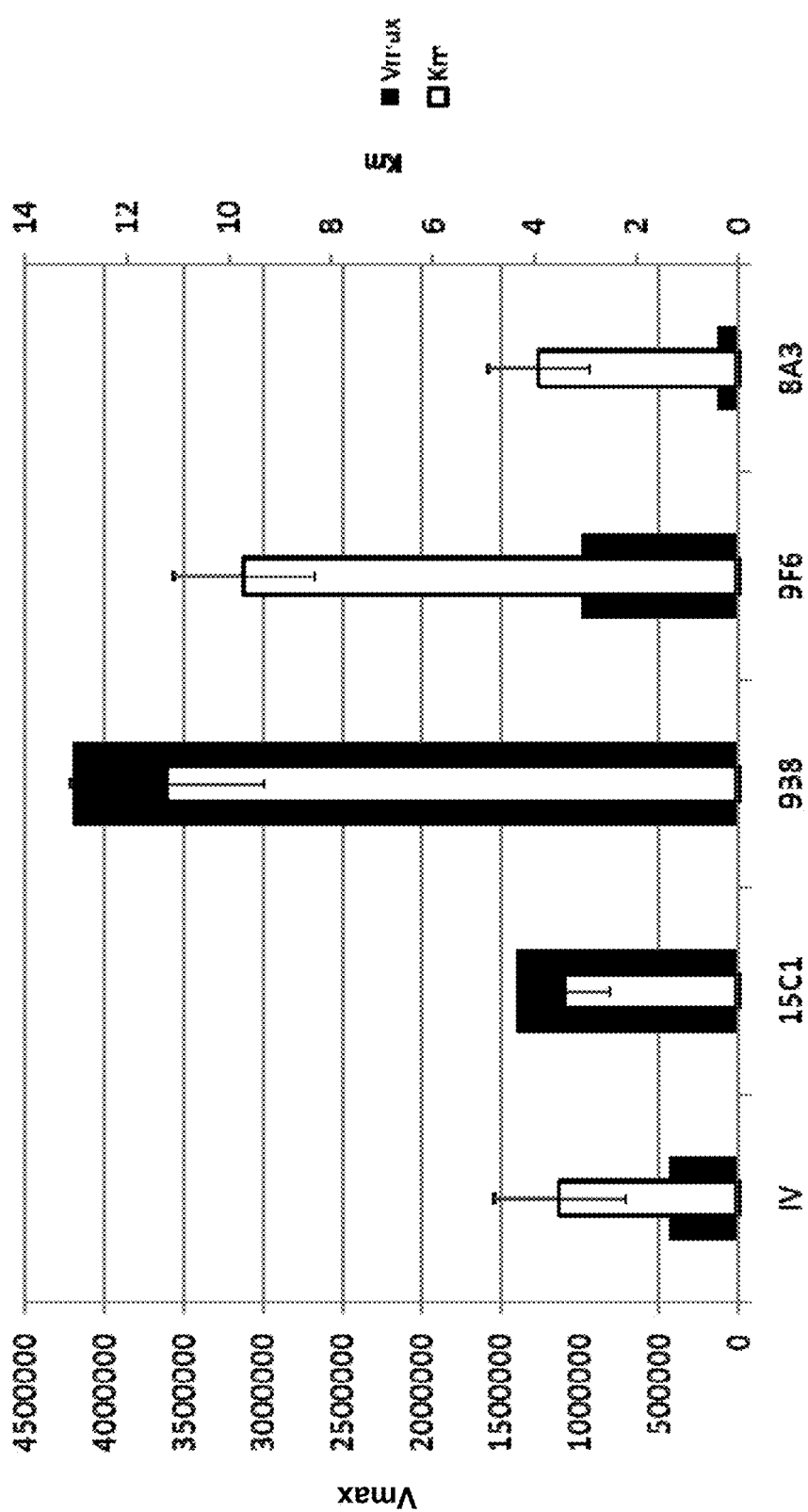
FIG. 35 shows the Vmax (RLU/sec) and Km (µM) values for various OgLuc variants in bacterial lysates using the novel coelenterazine PBI-3939 as a substrate.

Using methods known in the art, enzyme kinetic assays measuring luminescence were performed with the lysates of *E. coli* containing IV and the IV variants 15C1, 9B8, 9F6, and 9A3. Cells were induced, lysed, and diluted as described in Example 26 except the lysis buffer had a pH of 7.5. Two fold serial dilutions of PBI-3939 in the assay buffer described previously in Example 26 were assayed with the diluted lysates. FIG. 35 shows the Km and Vmax values calculated using a hyperbolic fit for IV and the variants 15C1, 9B8, 9F6, and 9A3. Variants 9B8 and 9F6 had higher Km values compared to IV while Km values for the other variants were unchanged. Variants 15C1, 9B8, and 9F6 all had higher Vmax values, while 8A3 had a lower Vmax value compared to IV.

Figure 36:
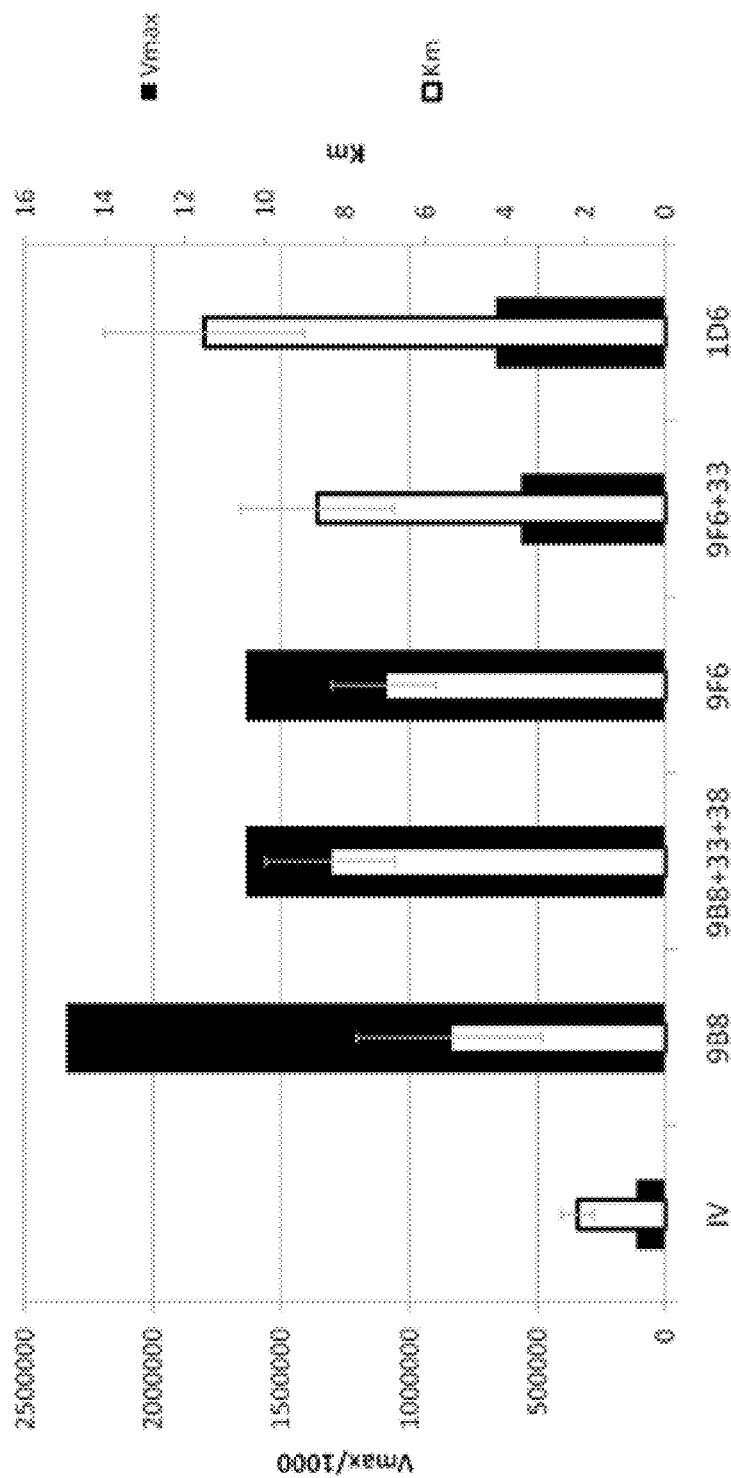
FIG. 36 shows the Vmax (RLU/sec) and Km (µM) values for various OgLuc variants in bacterial lysates using the novel coelenterazine PBI-3939 as a substrate.

15C1, which had the highest luminescence with PBI-3945 contained the amino acid substitution K33N, indicating that K33N provided increased luminescence. A 9B8 variant was generated to have this additional substitution to provide improvement in luminescence for this variant. Additional variants of 9B8 and 9F6 were generated to have at least one of amino acid substitutions K33N or V38I ("9B8+K33N+V38I" and "9F6+K33N"). Variant 1D6 was used to highlight the importance of amino acid substitutions at positions 68, 72, and 75 for increasing light output and stability. FIG. 36 shows the Km and Vmax values calculated using a hyperbolic fit for IV and the variants 9B8, 9B8+K33N+V38I, 9F6, 9F6+K33N, and 1D6. While the actual Km values were different between FIGS. 35 and 36 for 9B8 and 9F6, the general trend between the variants was consistent.

Figure 37:
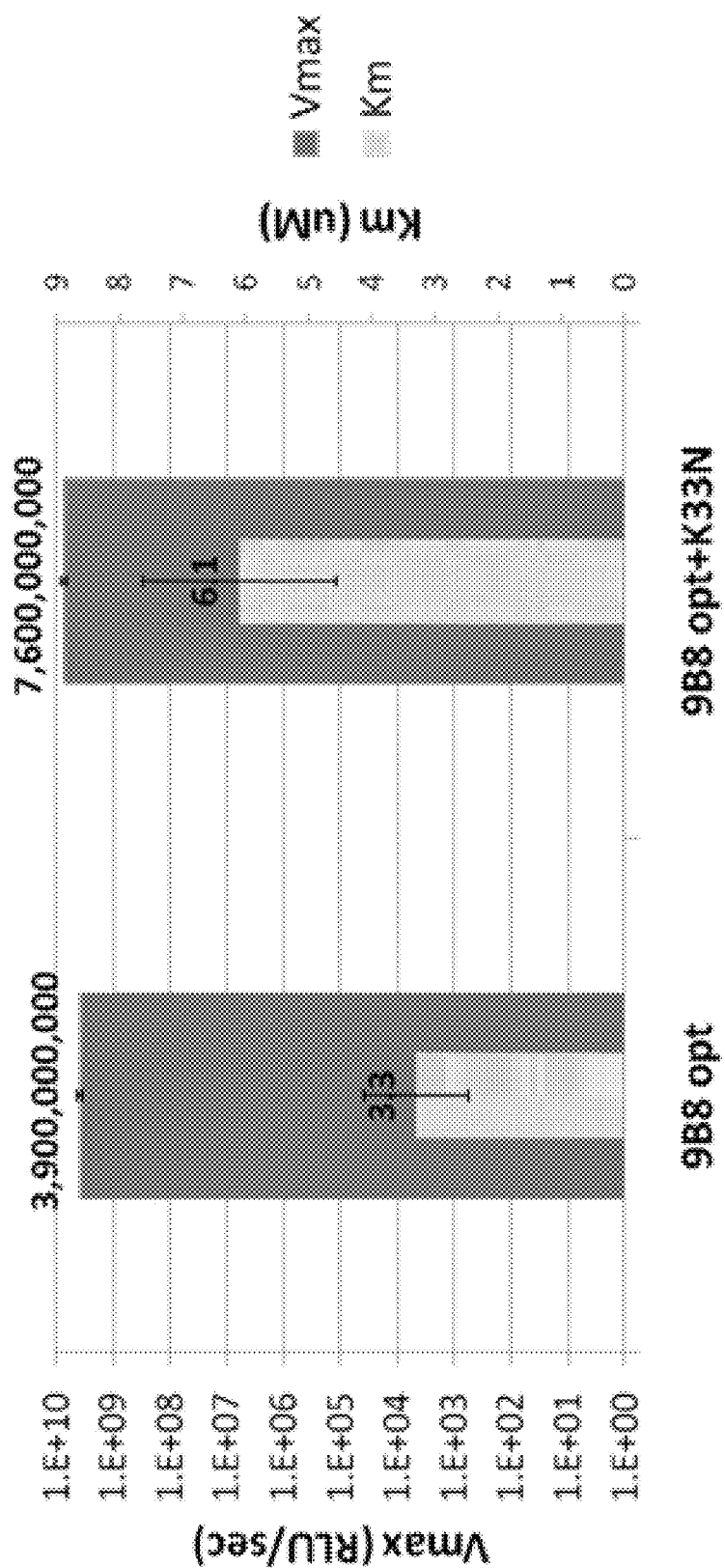
FIG. 37 shows the Vmax (RLU/sec) and Km (µM) values for 9B8 opt and 9B8 opt+K33N both in bacterial lysates using the novel coelenterazine PBI-3939 as a substrate.

The enzyme kinetics, i.e., Vmax and Km values, were determined and compared for the variants 9B8 opt and 9B8 opt+K33N as described above except the *E. coli* lysates were assayed with a buffer containing 1 mM CTDA, 150 mM KCl, 2 mM DTT, 100 mM MES pH 6.0, 35 mM thiourea, 0.25% TERGITOL® NP-9 (v/v), 10 mg/mL 2-hydroxypropyl-β-cyclodextrin, and 20 µM PBI-3939. Luminescence was measured on a TECAN® INFINITE® F500 luminometer. As shown in FIG. 37, the Vmax and Km values for 9B8 opt+K33N were higher than 9B8 opt, indicating that this clone is brighter and has a lower affinity for substrate.

B. 9B8 OPT+K33N Variants

The enzyme kinetics values were determined for the OgLuc variants as described previously, except luminescence was measured using a GLOMAX® luminometer. Three replicates were used for each variant. Table 23 shows the average Km and Vmax values with the standard deviation ("Km(+/−)" and "Vmax(+/−)" respectively) calculated using HYPER.EXE, Version 1.0.

TABLE 23

Vmax (RLU/0.5 sec) and Km (µM) values for OgLuc Variants

| sample | Km | Km (+/−) | Vmax | Vmax (+/−) |
| --- | --- | --- | --- | --- |
| 9B8 | 7.7 | 2.0 | 86,000,000 | 14,000,000 |
| K33N | 12.5 | 3.0 | 110,000,000 | 17,000,000 |
| T39T, Y68D | 7.9 | 1.8 | 74,000,000 | 10,000,000 |
| T39T, L27V, K43R | 21.4 | 5.4 | 150,000,000 | 28,000,000 |
| L27V, T39T, K43R, Y68D | 13.9 | 2.9 | 190,000,000 | 28,000,000 |
| T39T, K43R, Y68D | 10.5 | 2.8 | 140,000,000 | 25,000,000 |
| L27V, T39T, K43R, S66N | 16.3 | 4.8 | 130,000,000 | 28,000,000 |
| L27V, K43R, Y68D | 13.7 | 4.3 | 130,000,000 | 28,000,000 |
| L27V, Y68D | 10.2 | 3.0 | 97,000,000 | 19,000,000 |
| L27V K43R, S66N | 20.0 | 6.2 | 130,000,000 | 30,000,000 |

Example 28—Protein Stability of OgLuc Variants

As stability of the luciferase protein is another factor affecting luminescence, protein stability, i.e., thermal stability, of the variants was determined A. 15C1, 9B8, 9F6, 8A3 and IV Lysates of *E. coli* containing 15C1, 9B8, 9F6, 8A3 or IV and *E. coli* expressing hRL (SEQ ID NO: 30 and 31) were prepared from induced cultures as described previously. Lysate samples were diluted 1:1000 with a buffer containing 10 mM HEPES pH 7.5 with 0.1% gelatin. Diluted lysate (100 µL) samples, in replicate 96-well plates, were incubated at 50° C. At different time points, plates were placed at −70° C. (minus seventy degrees Celsius). Prior to measuring the luminescence as described previously, each plate was thawed at room temperature, i.e., 22° C., for 10 min. Samples (10 µL of each thawed sample) were assayed using native coelenterazine as a substrate. Luminescence was measured immediately after addition of assay buffer for each time point plate. The half-life of the protein, which indicated protein stability, was calculated from the luminescence data for each time point using methods known in the art.

Table 24 shows the protein stability of variants 15C1, 9B8, 9F6, and 8A3 having half-lives in min (hrs) of 630.1 (10.5), 346.6 (5.8), 770.2 (12.8) and 65.4 (1.1), respectively. In comparison, hRL had a half-life of 9.6 min, while IV had a half-life of 27.2 min. Table 24 also shows that at 4 hrs, 79%, 61%, and 80% of 15C1, 9B8, and 9F6, respectively, remained active.

TABLE 24

Protein Stability of OgLuc Variants at 50° C.

| Sample | ½ life (min) | ½ life (hrs) | % remaining at t = 4 hrs |
|---|---|---|---|
| Renilla | 9.6 | | |
| IV | 27.2 | | |
| 15C1 | 630.1 | 10.5 | 79% |
| 9B8 | 346.6 | 5.8 | 61% |
| 9F6 | 770.2 | 12.8 | 80% |
| 8A3 | 65.4 | 1.1 | |

B. 1D6, 9B8, 9B8+K33N+V38I, 9F6, 9F6+K33N, and IV

Figure 38:
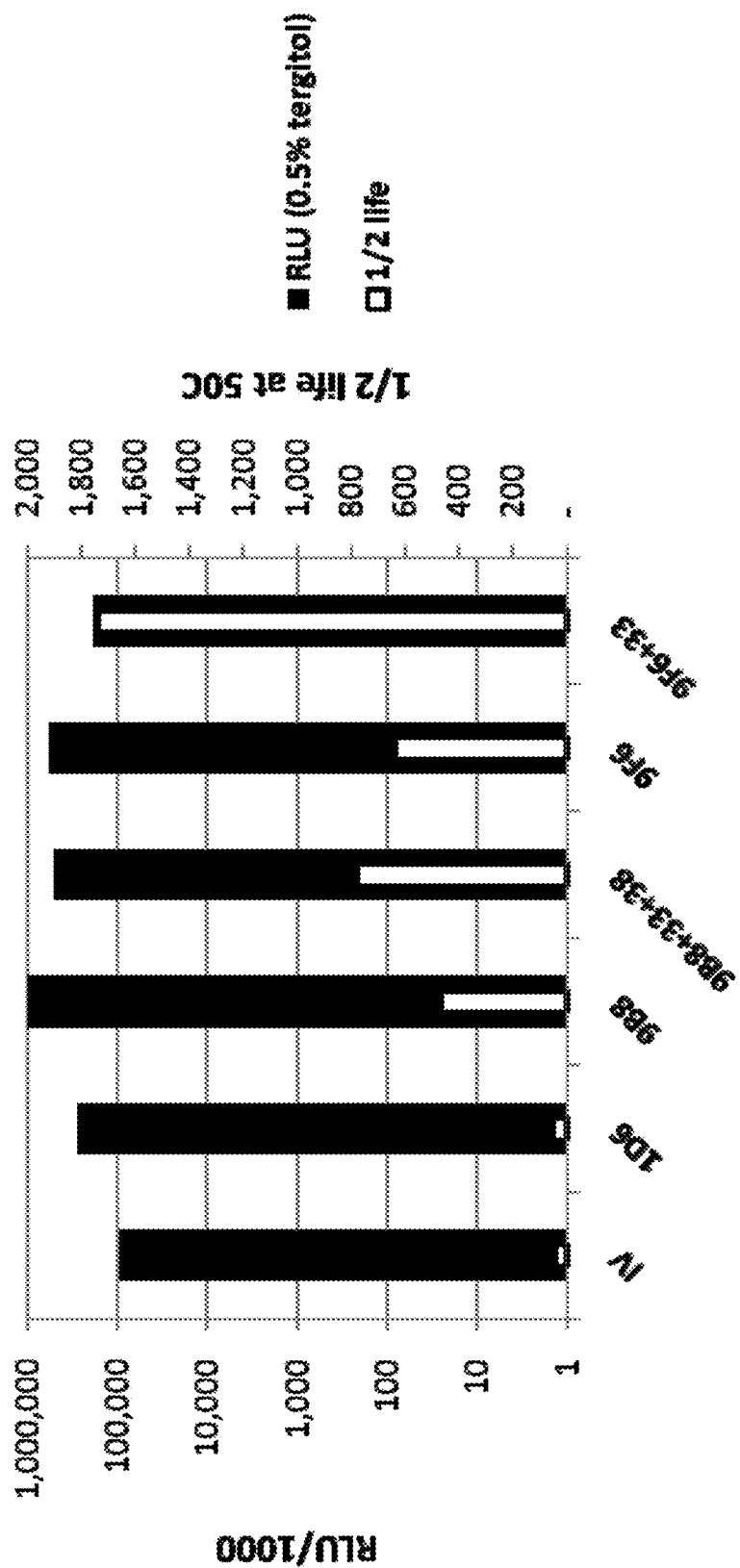
FIG. 38 shows the protein stability at 50° C. of various OgLuc variants in bacterial lysates using native coelenterazine as a substrate as the luminescence at t=0 and half-life in min

Lysates of E. coli containing 1D6, 9B8, 9B8+K33N+V38I, 9F6, 9F6+K33N, or IV were prepared from induced cultures and assayed for luminescence as described previously. Protein stability, i.e., thermal stability of the lysates, was assayed as described above in this Example. FIG. 38 shows the half-life in minutes (min) of the variants at 50° C., and the luminescence of the sample measured at the start of the incubation period, i.e., t=0, using native coelenterazine as a substrate. The difference between variant 9B8+33+38 and 9F6 was one amino acid substitution, L27V, indicating that this amino acid substitution increased stability. The addition of "activity/expression" substitutions in positions 68, 72, and 75 increased stability. FIG. 38 shows K33N provided greater thermal stability to variant 9F6 and that variant 9B8 had greater light output and stability than variant 1D6. The difference between these two variants, i.e., 9B8 contains additional amino acid substitutions F68Y, L72Q, and M75K, indicated the importance of these three substitutions.

Figure 39:
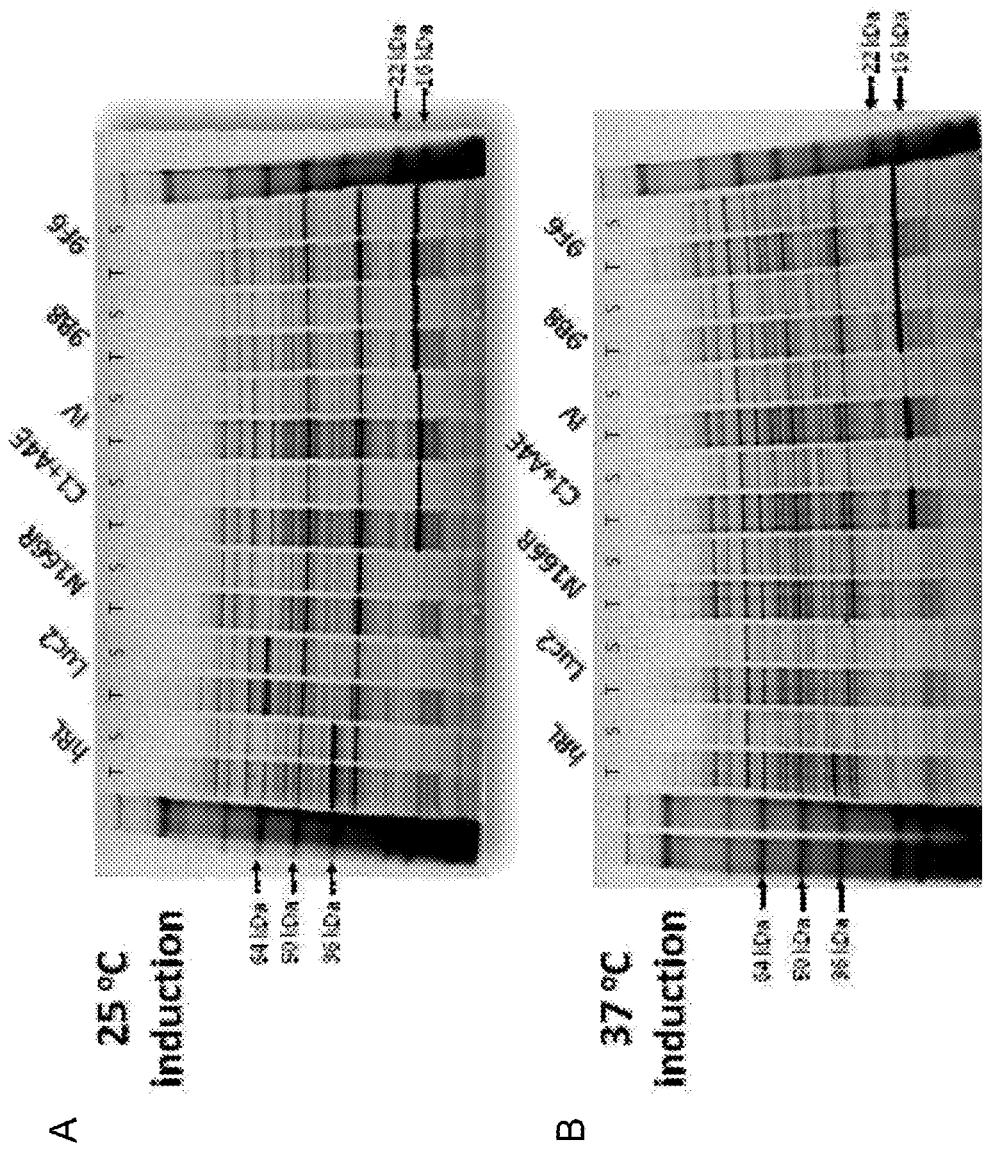
FIGS. 39A-B show the structural integrity (determined by expression, stability, and solubility as shown by SDS-PAGE analysis) in bacterial lysates of various OgLuc variants at 25° C.

In addition to thermal stability, structural integrity determined by expression, stability, and solubility can also affect luminescence. As a way to further test the structural integrity of the improved variants, KRX E. coli harboring pF4Ag-based (i.e., no HT7) OgLuc variants N166R (previously described in U.S. Serial application Ser. No. 12/773,002 (U.S. Published Application No. 2010/0281552)), C1+A4E, IV, 9B8, and 9F6 were grown at 37° C. in Luria broth (LB) to an $OD_{600}$=0.6 and then induced for overexpression by the addition of rhamnose (0.2% final concentration). Duplicate induced cultures were then grown at either 25 or 37° C. for 17 hrs at which time total (T) and soluble (S) fractions were prepared and analyzed by SDS-PAGE using SIMPLY-BLUE™ SafeStain (Invitrogen) to stain the gels (FIGS. 39A-B). hRL and Luc2 were used as controls.

The OgLuc variants, hRL and Luc2 expressed well and were soluble when the induction occurred at 25° C. (FIG. 39A; note the approximately 19 kDa dark band in the "soluble" fraction for the OgLuc variants, excluding the N166R variant, and the approximately 36 and 64 kDa bands in the "soluble" fraction for hRL and Luc2, respectively). In contrast, although C1+A4E, IV, 9B8, and 9F6 expressed well at 37° C. (significantly better than hRL or Luc2, as shown in the "total" fraction), only the 9B8 and 9F6 variants were soluble when the elevated induction temperature was employed (see FIG. 39B; note the approximately 19 kDa dark band in the "soluble" fraction for 9B8 and 9F6). These results tracked with the thermal stability data shown in Table 24 and FIG. 38.

C. 9B8 Opt and 9B8 Opt+K33N

Figure 40:
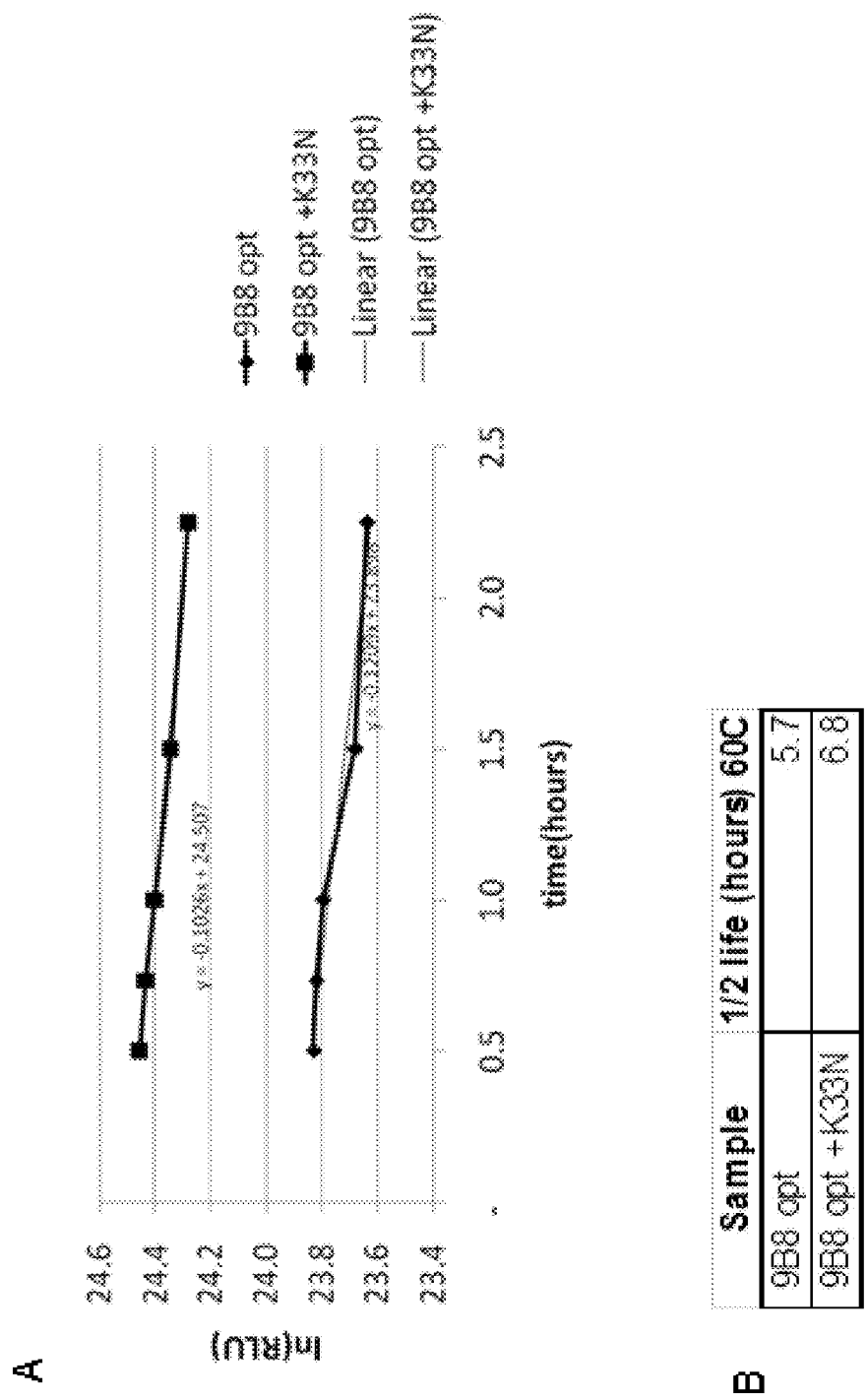
FIGS. 40A-B show the protein stability at 60° C. in bacterial lysates of 9B8 opt and 9B8 opt+K33N using the novel coelenterazine PBI-3939 as a substrate as the natural log (ln) of the luminescence (in RLU) over time (FIG. 40A) and as the half-life in hrs (FIG. 40B).

The thermal stability of the variants 9B8 opt and 9B8 opt+K33N was compared. E. coli lysates containing the variant 9B8 opt or 9B8 opt+K33N were prepared and analyzed as described previously with the following exceptions: Lysates were diluted 1:100 in the lysis buffer described previously and replicate diluted lysates were incubated at 60° C. in a thermocycler. Aliquots were removed at different time-points and placed on dry ice to freeze the samples. Frozen lysates were thawed at 22° C. and assayed with a buffer containing 20 mM CDTA, 150 mM KCl, 10 mM DTT, 20 µM PBI-3939, 100 mM HEPES pH 7.0, 35 mM thiourea, and 0.1% TERGITOL® NP-9 (v/v). Luminescence was measured on a GLOMAX® luminometer (Promega Corp.). FIG. 40A shows the light output time course of the natural logarithm (ln) value of luminescence measured in RLU over time in min. As shown in FIG. 40B, 9B8 opt+K33N had a half-life at 60° C. of 6.8 hrs, which was longer than the 5.7 hrs half-life of 9B8 opt.

Table 25 shows the thermal stability at 60° C. ("$T_{1/2}$ (60° C.)") of 9B8 opt and 9B8 opt+K33N, and the luminescence ("RLU") data at the start of the incubation period (i.e., t=0). 9B8 opt+K33N was more stable and approximately 1.8-fold brighter than 9B8 opt, indicating that the amino acid substitution K33N provided both greater light output and higher thermal stability.

TABLE 25

Thermal Stability and Luminescence Data for 9B8 opt and 9B8 opt + K33N

| Variant | $T_{1/2}$ (60° C.) | RLU |
|---|---|---|
| 9B8 opt | 5.7 hrs | 23,283,252,000 |
| 9B8 opt + K33N | 6.8 hrs | 42,278,732,000 |

D. 9B8+K33N Variants

Figure 41:
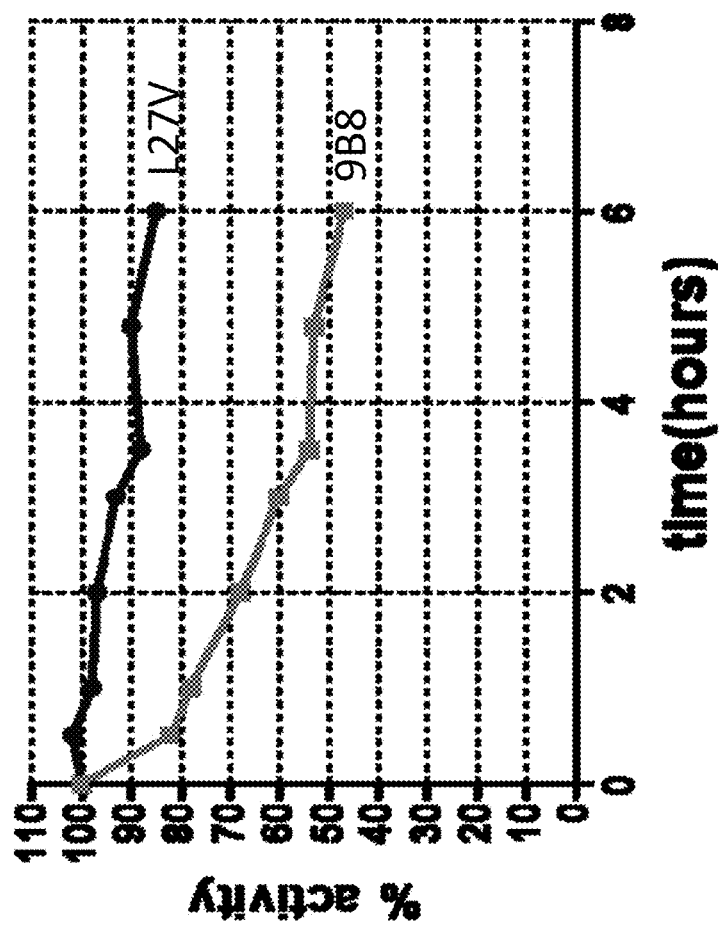
FIG. 41 shows the percent activity of the OgLuc variants 9B8 and L27V at 60° C.

The thermal stability of the variants at 60° C. was examined as described above, except the assay buffer contained 100 mM MES pH 6.0 instead of HEPES. Table 26 and FIG. 41 shows the half-life in hrs of the variants at 60° C. The data indicates that the amino acid substitution L27V improves thermal stability.

TABLE 26

Thermal stability of OgLuc variants at 60° C.

| Sample | ½ life hours |
|---|---|
| 9B8 | 5.1 |
| K33N | 6.7 |
| T39T, Y68D | 16.3 |
| T39T, L27V, K43R | 11.8 |
| L27V, T39T, K43R, Y68D | 21.7 |
| T39T, K43R, Y68D | 15.2 |
| L27V, T39T, K43R, S66N | 11.8 |
| L27V, K43R, Y68D | 23.2 |
| L27V, Y68D | 28.5 |
| L27V, K43R, S66N | 10.7 |

The variants 9B8 and V2 (9B8+K33N+T39T+K43R+Y68D) were also screened in HEK293 cells to determine their stability. The variants were cloned into pF4Ag and transfected into HEK293 cells (15,000 cells/well) as previously described. After transfection, the cells were lysed in assay reagent (as previously described; no PBI-3939), and luminescence measured using the assay reagent with 20 µM PBI-3939. 9B8 had a half-life of 5.2 hrs while V2 had a half-life of 16.8 hrs. This is consistent with the half-life seen for these variants in *E. coli* (Table 26).

E. L27V Variant

Figure 42:
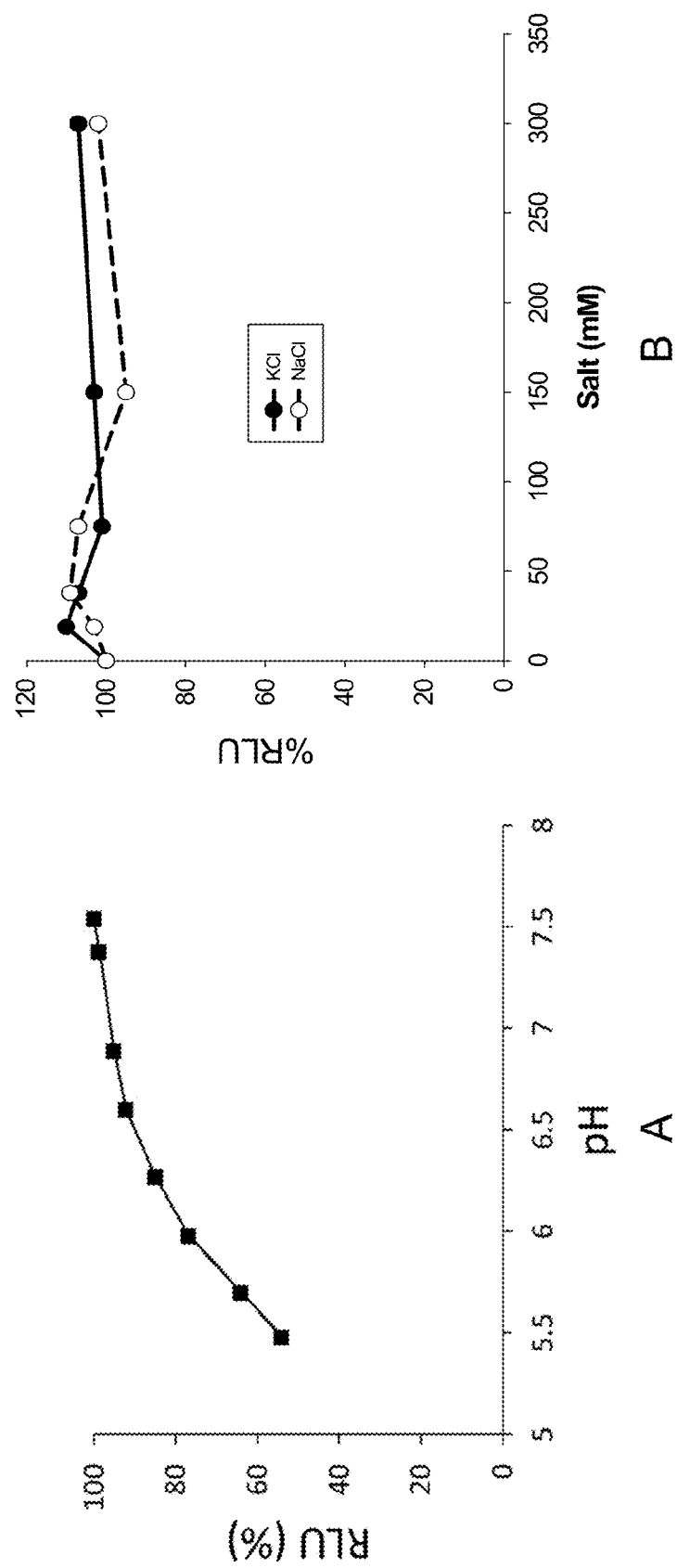
FIGS. 42A-B show the protein stability of the OgLuc variant L27V at various pH (FIG. 42A) and salt concentrations (FIG. 42B).

The activity of the L27V variant (9B8+K33N+L27V+T39T+K43R+Y68D) was assessed at various pHs and different salt conditions. 9B8 and 9B8+K33N were previously shown to have similar stability at pH 6 and pH 7 (data not shown). For assessing activity at various salt conditions, 50 µL of assay buffer with 20 µM PBI-3939 and varying amounts of KCl or NaCl was mixed with 50 µL of HEK293 cells transiently transfected with L27V (pF4Ag). Luminescence was measured, and the percent activity (the ratio of luminescence to no salt) determined (FIG. 42B). For assessing activity in various pHs, a reagent was made containing 100 mM citrate, 100 mM MES, 100 mM PIPES, 100 mM HEPES, 100 mM TAPS, 0.5% TERGITOL® NP-9 (v/v), 0.05% MAZU® DF 204, 1 mM CDTA, and 1 mM DTT titrated to various pH values. 362 µM L27V in assay reagent was mixed with substrate 100 µM PBI-3939 and luminescence was measured. (FIG. 42A).

Example 29—Gel Filtration Chromatographic Analysis of OgLuc Variants

A. C1+A4E and 9B8

Figure 43:
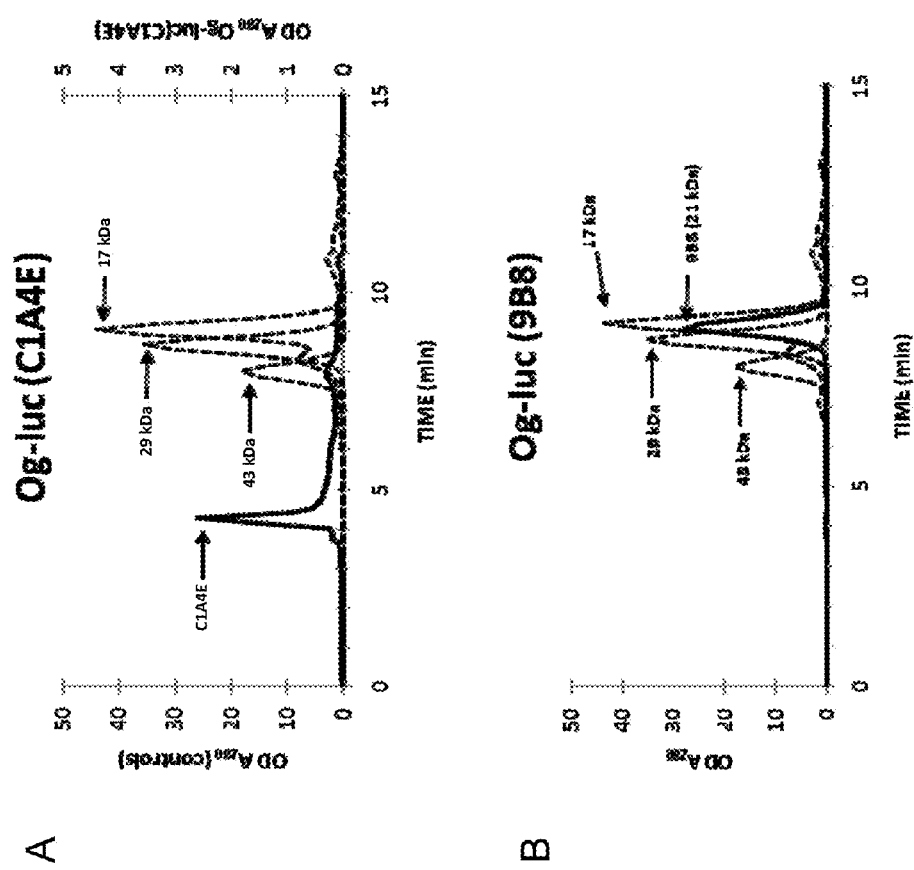
FIGS. 43A-B shows the gel filtration chromatographic analysis of purified C1+A4E (FIG. 43A) and 9B8 (FIG. 43B).

Gel filtration analysis was used to verify the expected molecular weight of the purified OgLuc proteins based on the theoretical values and consequently to determine their oligomeric state. A comparison between the relative hydrodynamic volume of the OgLuc variants C1+A4E and 9B8 was made by gel filtration chromatography. For this analysis, the nucleotide sequence for the OgLuc variants, C1+A4E and 9B8, were cloned into a HQ-Tagged FLEXI® Vector (Promega Corp.) to create a HQHQHQ N-terminally tagged protein that was overexpressed in *E. coli* KRX cells. The overexpressed proteins were purified using the HIS-LINK™ Protein Purification System (Promega Corp.) according to manufacturer's instructions. Samples of each individual standard and sample protein were analyzed by gel filtration chromatography, which was performed at 24° C. on an Agilent 1200 HPLC, using a Superdex 200 5/150 GL column (GE Healthcare) with a flow rate of 0.25 mL/min (FIGS. 43A-B). The mobile phase (i.e., running buffer) consisted of 50 mM Tris and 150 mM NaCl, pH 7.5. Protein elution was monitored at 214 and 280 nm. A standard calibration curve was generated using: 1) Ovalbumin, 43 kDa (GE Healthcare), 2) Carbonic Anhydrase, 29 kDa (Sigma) and 3) Myoglobin, 17 kDa (Horse Heart, Sigma). The molecular weights of the purified proteins were calculated directly from the calibration curve.

The relative elution of the proteins observed with this column was Ovalbumin at 7.98 min, Carbonic Anhydrase at 8.65 min, 9B8 at 8.97 min, and Myoglobin at 9.06 min (FIGS. 43A-B). As shown in FIG. 43B, 9B8 eluted as a 21 kDa protein (predicted MW is approximately 19 kDa) indicating that the 9B8 variant existed as a monomer, whereas C1+A4E eluted at approximately 4.3 min (FIG. 43A), indicating that C1+A4E was expressed and exists as multimer, e.g., possibly as a tetrameric complex or something larger.

B. L27V Variant

Figure 44:
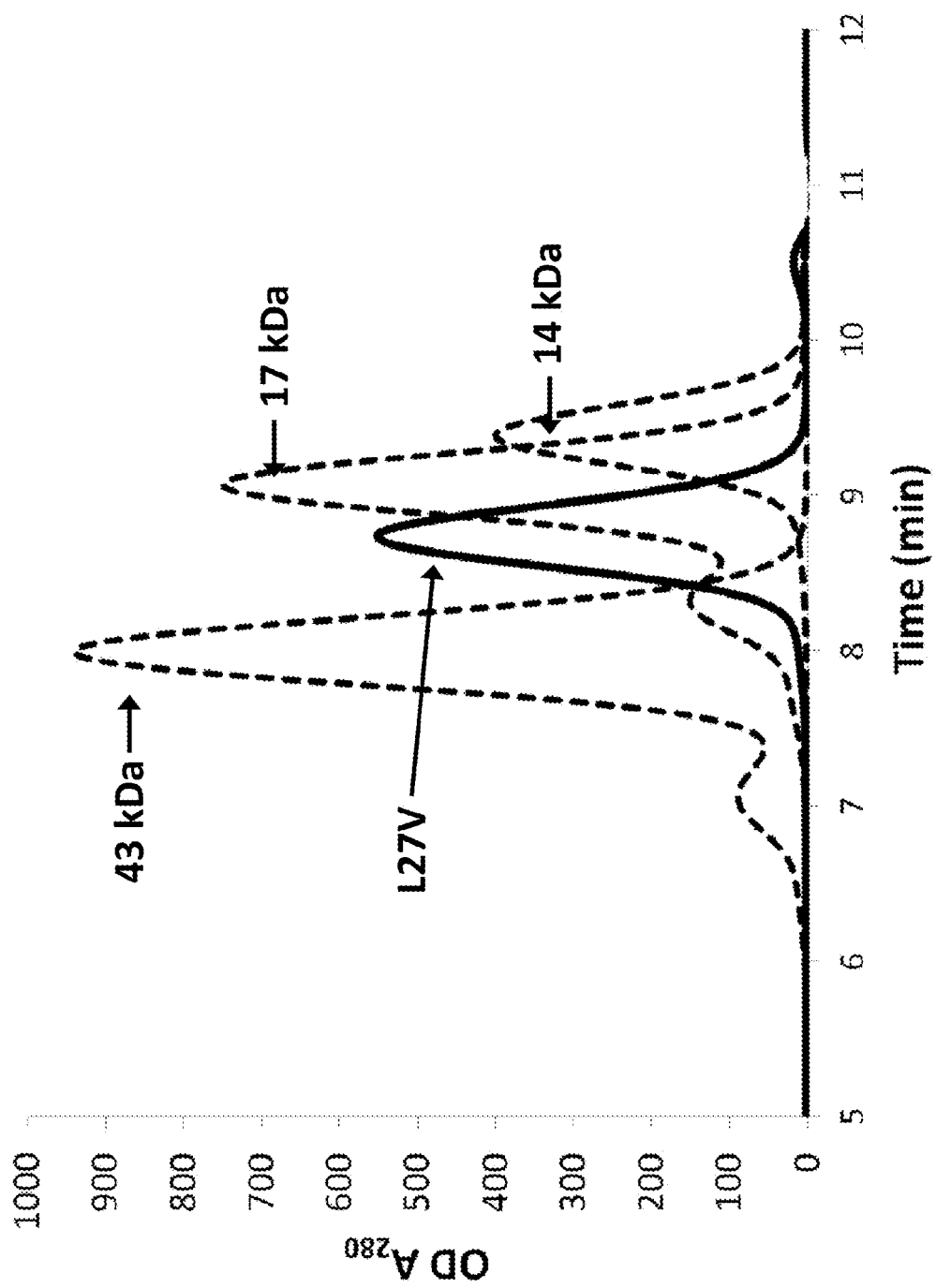
FIG. 44 shows the gel filtration chromatographic analysis demonstrating that the OgLuc variant L27V exists in a monomeric form.
Figure 56:
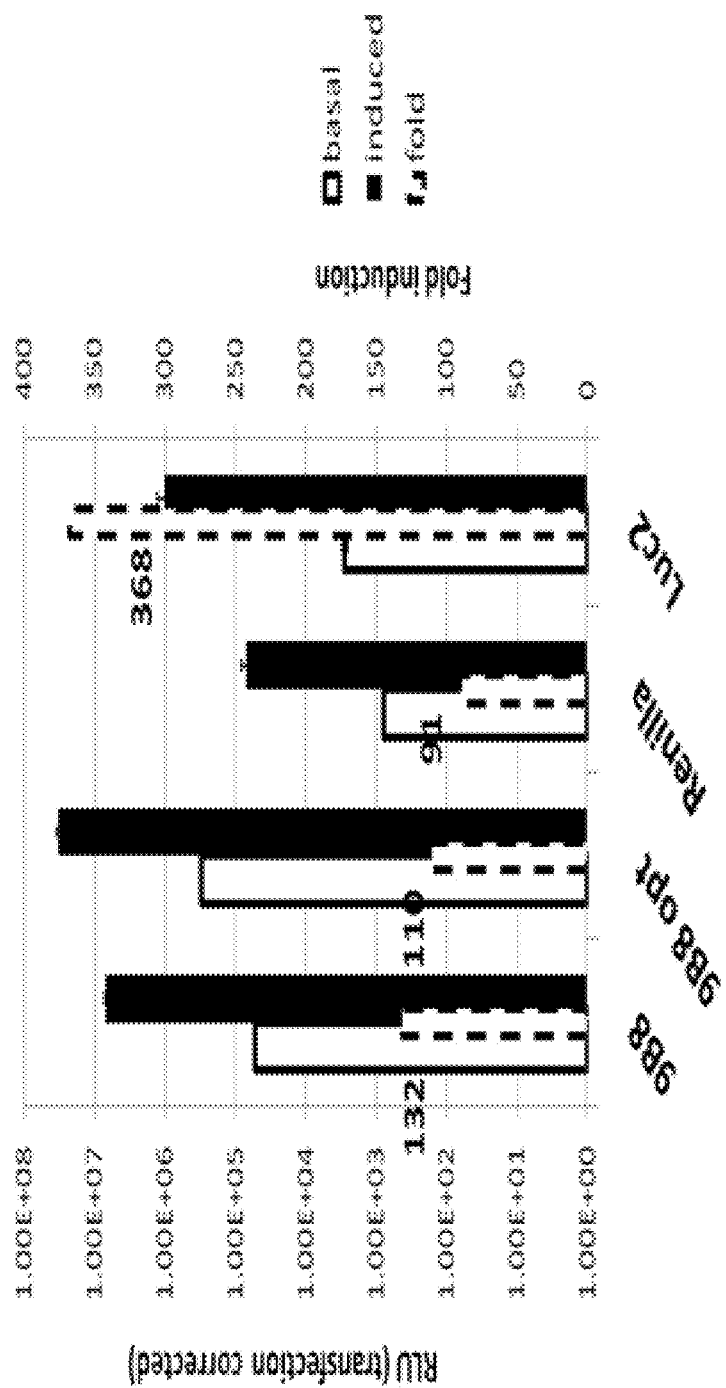
FIG. 56 shows the normalized luminescence generated from lysed HEK293 cells expressing the 9B8, 9B8 opt, hRL ("Renilla") or firefly luciferase ("Luc2") cAMP transcriptional reporter using PBI-3939 (for 9B8 and 9B8 opt), native coelenterazine (for hRL) or luciferin (BRIGHT-GLO™ Assay Reagent; for Luc2) as a substrate with ("+FSK") or without ("−FSK") forskolin treatment and the fold induction (response) due to forskolin treatment ("FOLD").

To demonstrate that the OgLuc variant L27V exists in a monomeric state, gel filtration analysis was used to verify the expected molecular weight of the purified L27V protein based on the theoretical value, and consequently to determine its oligomeric state. The relative hydrodynamic volume of the L27V variant was made by gel filtration chromatography. For this analysis, the nucleotide sequence for the L27V variant was cloned into a HaloTag® vector pFN18A (Promega Corp.) to create a HaloTag®-terminally tagged protein that was overexpressed in *E. coli* KRX cells (Promega Corp.). The overexpressed protein was purified using the HaloTag® Protein Purification System (Promega Corp.) according to manufacturer's instructions. Samples of each individual standard and sample protein were analyzed by gel filtration chromatography performed at 24° C. on an Agilent 1200 HPLC using a Superdex 200 5/150 GL column (GE Healthcare) with a flow rate of 0.25 mL/min (FIG. 56). The mobile phase (i.e., running buffer) consisted of 50 mM Tris and 150 mM NaCl, pH 7.5. Protein elution was monitored at 214 and 280 nm. A standard calibration curve was generated using: 1) Ovalbumin, 43 kDa (GE Healthcare), 2) Myoglobin, 17 kDa (Horse Heart, Sigma), and 3) Ribonuclease, 14 kDa (Bovine pancreas, GE Healthcare). As shown in FIG. 44, the L27V variant eluted as a 24 kDa protein (predicted MW is approximately 19 kDa) indicating that it existed as a monomer.

Example 30—Protein Expression Levels of OgLuc Variants

A. IV, 8A3, 8F2, 9B8, 9F6 and 15C1

Figure 45:
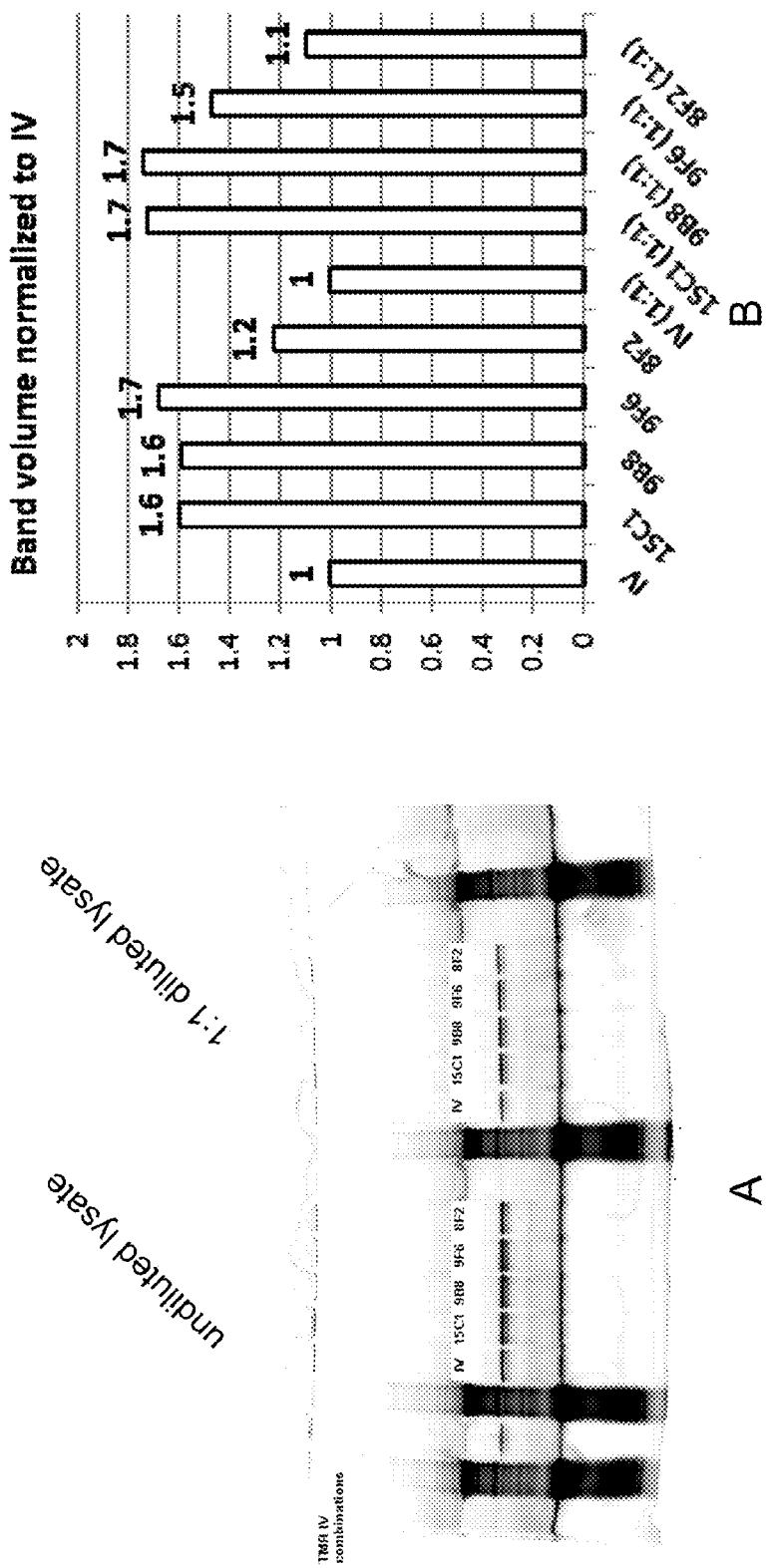
FIGS. 45A-B show the protein expression levels of various OgLuc variant-HALOTAG® (HT7) fusion proteins in undiluted and 1:1 diluted bacterial lysate samples analyzed by SDS-PAGE (FIG. 45A) and the normalized protein expression levels (FIG. 45B).

Normalizing for protein expression provides information about potential differences in specific activity. To provide a means for quantifying protein expression, OgLuc variants were cloned into a pF4Ag vector containing a C-terminal HT7 to generate OgLuc variant-HT7 fusion proteins as described previously. The following fusion proteins were generated: IV-HT7 (SEQ ID NOs: 48 and 49), 8A3-HT7 (SEQ ID NOs: 34 and 35), 8F2-HT7 (SEQ ID NOs: 50 and 51), 9B8-HT7 (SEQ ID NOs: 36 and 37), 9F6-HT7 (SEQ ID NOs: 38 and 39), and 15C1-HT7 (SEQ ID NOs: 52 and 53). *E. coli* containing the OgLuc variant-HT7 fusions were grown and induced as described previously. 900 µL of cell culture was lysed with 100 µL of 10× FASTBREAK™ Cell Lysis Reagent (Promega Corp.). HALOTAG® TMR-ligand (Promega Corp.) was added to each bacterial lysate sample to obtain a final concentration of 0.5 µM. Bacterial lysates were incubated with the HALOTAG® TMR-ligand for 30 min at room temperature according to manufacture's instructions. 10 µL of each sample was diluted 1:1 with 1× FASTBREAK™, i.e., 10 µL sample to 10 µL 1× FASTBREAK™. 15 µL of the lysate and 15 µL of the 1:1 dilution for each sample were analyzed by SDS PAGE. The labeled fusion proteins were resolved by SDS-PAGE, stained with SIMPLYBLUE™ SafeStain (FIG. 45A) and fluorimaged (GE Healthcare Typhoon). Bands were quantitated using Imagequant software (GE Healthcare). FIG. 45B shows the band volume measured from FIG. 45A for IV-HT7 ("IV"), 15C1-HT7 ("15C1"), 9B8-HT7 ("9B8"), 9F6-HT7 ("9F6"), and 8F2-HT7 ("8F2"), normalized to IV-HT7. The data shows that the IV variants expressed well compared to IV.

B. 9B8 Opt, V2 and L27V

Figure 46:
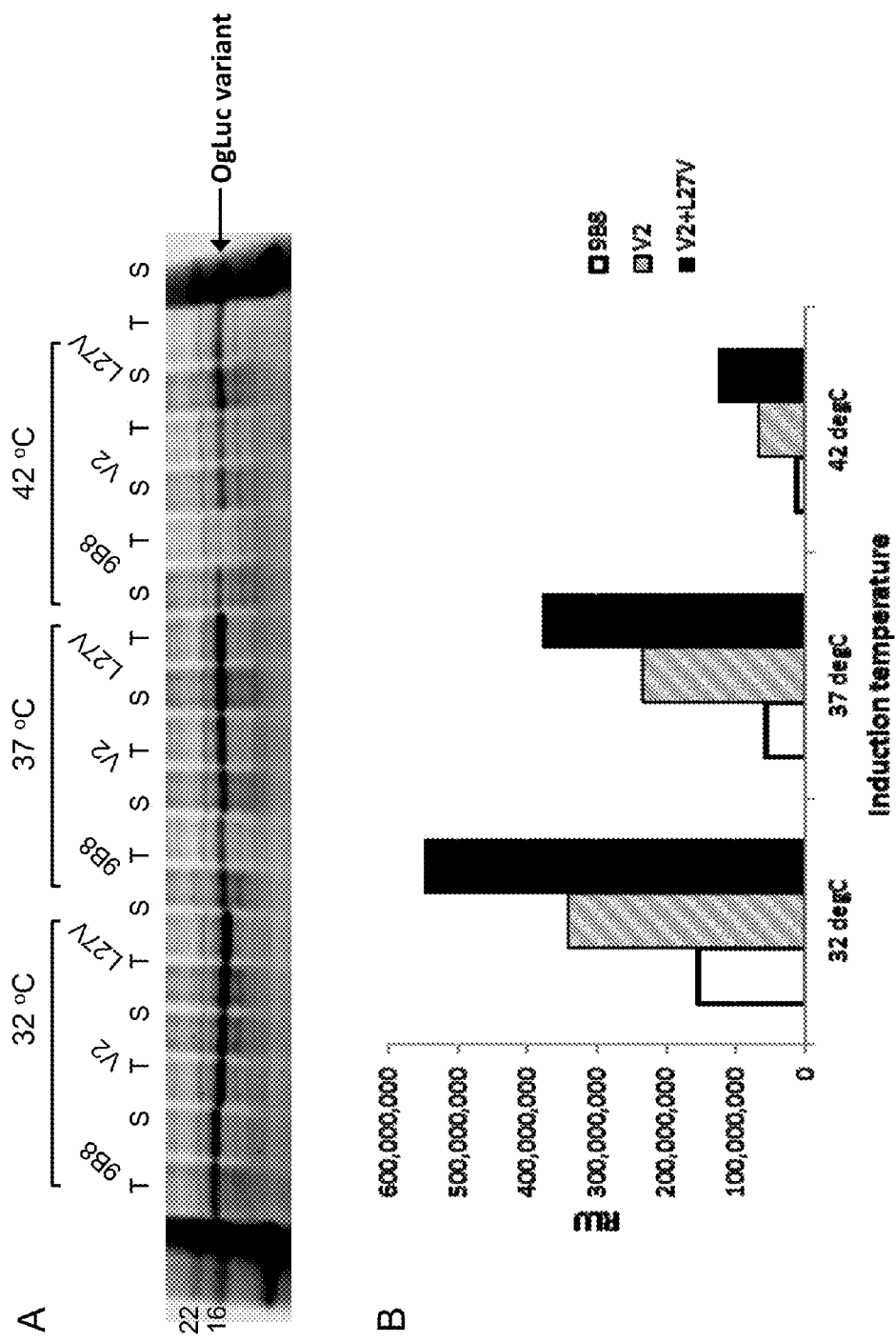
FIGS. 46A-B show the protein expression (FIG. 46A) and solubility of the OgLuc variants 9B8 opt, V2 and L27V (FIG. 46B).

The expression levels and solubility of 9B8 opt, V2 and L27V were compared. These three variants, in the context of a pF4Ag background, were used to transform *E. coli* KRX cells. The resulting clones were used for an expression experiment where single colonies were grown overnight at 30° C., diluted 1:100 in LB, grown to an $OD_{600}$ approximately 0.5, and then induced with 0.2% rhamnose for 18 hrs at 25° C. Cells were then incubated for 30 min at room temperature in the presence of 0.5× FASTBREAK™ Lysis Reagent (Promega Corp.), and the resulting lysates stored at −20° C. Following a slow-thaw on ice, soluble fractions were prepared by high-speed centrifugation for 10 min at 4° C. Crude total (T) and soluble (S) fractions were then analyzed for expression levels using SDS-PAGE+Simply blue staining (FIG. 46A) as well as by measuring luminescence (FIG. 46B). For luminescence measurement, 50 µL of soluble lysates in 96-well microtiter plates were mixed with 50 µL assay reagent (previously described; 40 µM PBI-3939), and luminescence measured using a TECAN® INFINITE® F500 multi-detection plate reader. These results indicate that the ranking for these three variants, in terms of their expression levels and solubility, is L27V>V2>9B8opt.

Example 31—Brightness of OgLuc Variants Expressed in Mammalian Cells

A. IV and 9B8

Figure 47:
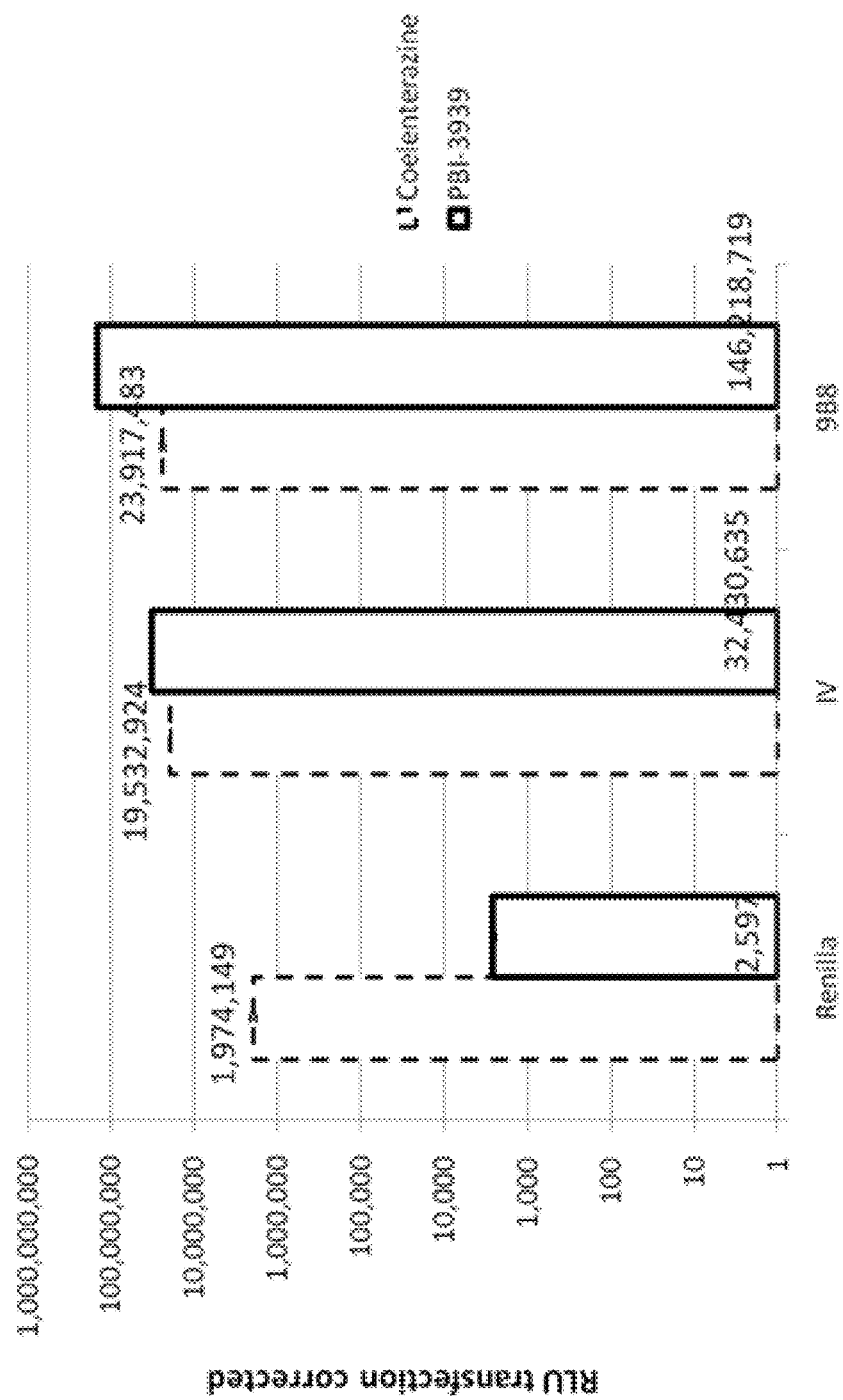
FIG. 47 shows the normalized luminescence in RLUs generated from lysed HEK293 cells expressing IV, 9B8, and hRL ("Renilla") using native coelenterazine and the novel coelenterazine PBI-3939 as substrates.

The IV and 9B8 variant in pF4Ag vector (i.e., no HT7) were evaluated for brightness in HEK293 cells. hRL was used as a control. Briefly, HEK293 cells, plated at 15,000 cells/well in a 96-well plate, were transiently transfected using TRANSIT®-LT1 with plasmid DNAs encoding the various variants and/or control sequences. Cells were grown, lysed, and treated as described in Example 25. Cells were co-transfected with pGL4.13 (Promega Corp.) as a transfection control (10 ng/transfection or 10% of the total DNA transfected was used). Luminescence was measured as described previously using native coelenterazine as a substrate for hRL or PBI-3939 as a substrate for the OgLuc variants. The OgLuc variant data was corrected for transfection efficiency using Luc2 luminescence (i.e., measuring luminescence after the addition of luciferin substrate). The OgLuc variants IV and 9B8 had greater luminescence compared to hRL ("*Renilla*") (FIG. 47).

For comparison of brightness on a per mole basis in mammalian cells, the C-terminal HT7 fusion protein of variant 9B8 ("pF4Ag-OgLuc-9B8-HT7") described in Example 30 was analyzed and compared with C-terminal HT7-hRL fusion protein ("pF4Ag-*Renilla*-HT7") and C-terminal HT7-Luc2 fusion protein ("pF4Ag-Luc2-HT7"). HEK293 cells (15,000) were plated and grown overnight at 37° C. These cells were transfected with 100 ng of DNA from pF4Ag-*Renilla*-HT7, pF4Ag-Luc2-HT7, or pF4Ag-OgLuc-9B8-HT7 and grown overnight at 37° C. Media was removed and cells were lysed as described previously. 10 µL of each sample was assayed for luminescence (RLU) with 50 µL BRIGHT-GLO™ for Luc2, 50 µL of 20 µM native coelenterazine for hRL, and 50 µL of 20 µM PBI-3939 for variant 9B8.

Figure 48:
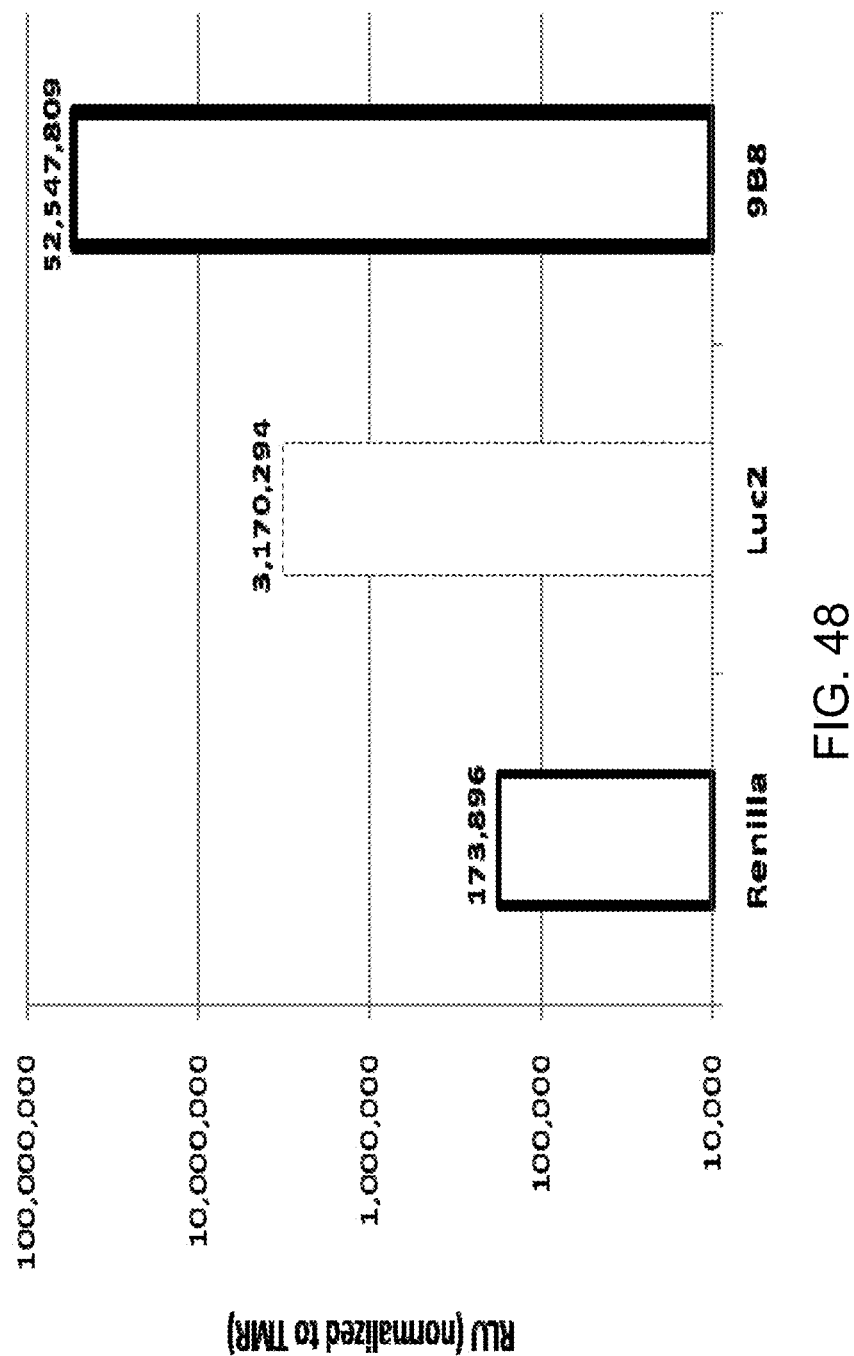
FIG. 48 shows the normalized luminescence in RLUs generated from lysed HEK293 cells expressing pF4Ag-Ogluc-9B8-HT7, pF4Ag-Luc2-HT7 and pF4Ag-Renilla-HT7 using PBI-3939, Luciferin (BRIGHT-GLO™ Assay Reagent), and native coelenterazine, respectively, as a substrate.

The lysates from 6 wells were pooled and labeled with HALOTAG® TMR-ligand as described in Example 30. The labeled fusion proteins were resolved by SDS-PAGE and fluorimaged (GE Healthcare Typhoon). The band densities were determined to quantitate the relative number of moles present for each luciferase enzyme and the RLU value for each sample was normalized by the calculated band density to normalize expression levels of each protein, i.e., RLUs normalized using TMR label quantitation (FIG. 48). On a mole-to-mole basis, the 9B8 variant was approximately 15-fold brighter than Luc2 and >100-fold brighter than hRL. This data represented differences in specific activity.

B. 9B8 Opt and 9B8 Opt+K33N

Figure 49:
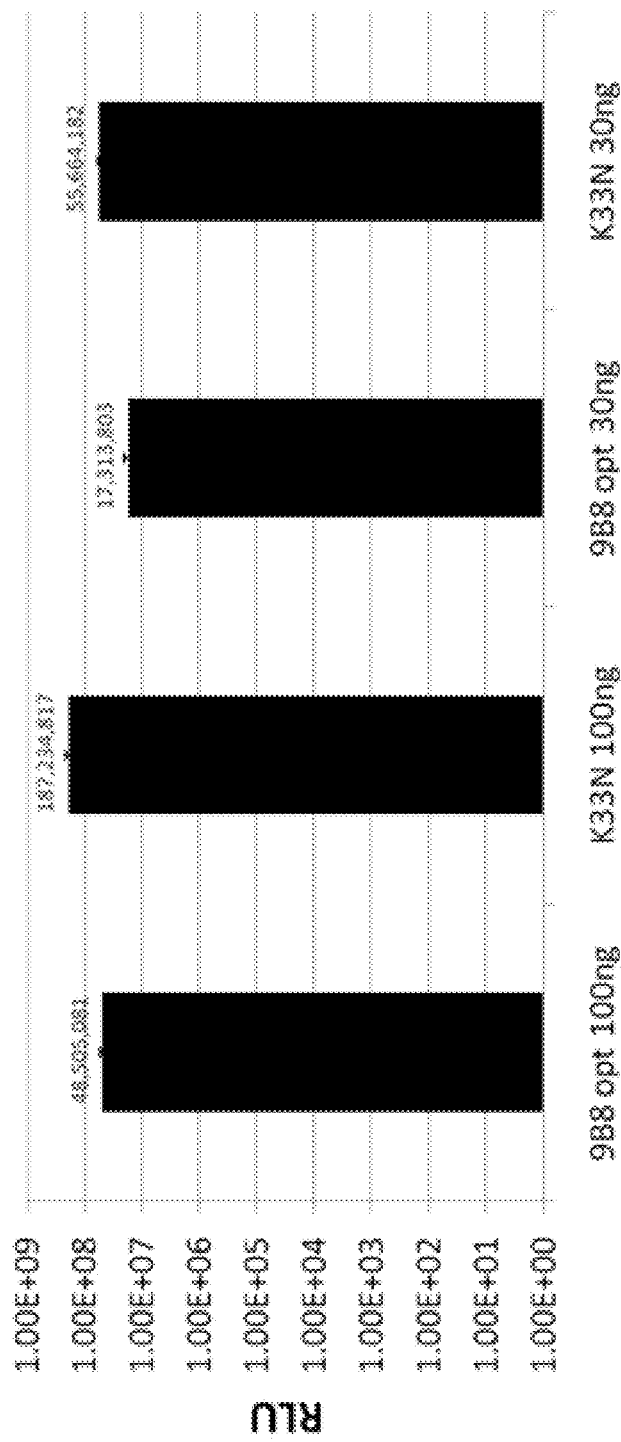
FIG. 49 shows the luminescence generated from lysed HEK293 cells expressing 30 or 100 ng of plasmid DNA encoding either 9B8 opt or 9B8 opt+K33N ("K33N") using the novel coelenterazine PBI-3939 as a substrate.

The brightness of the variants 9B8 opt and 9B8 opt+K33N expressed in HEK293 cells was measured and compared as described for the variants without the HT7 in Example 31. 30 and 100 ng of plasmid DNA containing the variant DNA was used to transfect HEK293 cells. Cells were grown and induced as described in Example 31 except the cells were lysed with a lysis buffer containing 1 mM CTDA, 150 mM KCl, 2 mM DTT, 100 mM MES pH 6.0, 35 mM thiourea, 0.25% TERGITOL® NP-9 (v/v), and 10 mg/mL 2-hydroxypropyl-β-cyclodextrin. The lysates were assayed with lysis buffer containing 20 µM PBI-3939 and luminescence was measured on a TECAN® GENIOS™ Pro luminometer. As shown in FIG. 49, 9B8 opt+K33N had greater luminescence compared to 9B8 opt in HEK293 cells, which tracks with the bacterial expression data in Table 25 and FIG. 29.

C. 9B8+K33N Variants

The brightness of the variants expressed in HEK293 and NIH3T3 cells was measured as described previously. The luminescence of the variants was normalized to the luminescence generated by 9B8 opt (Table 27).

TABLE 27

Increase in Luminescence generated by OgLuc combination variants in NIH3T3 and HEK293 cells

| Sample | HEK293 | NIH3T3 |
|---|---|---|
| 9B8 | 1.0 | 1.0 |
| K33N | 1.8 | 1.5 |
| T39T, Y68D | 1.9 | 1.5 |
| T39T, L27V, K43R | 1.3 | 0.9 |
| L27V, T39T, K43R, Y68D | 1.6 | 1.6 |
| T39T, K43R, Y68D | 1.9 | 1.9 |
| L27V, T39T, K43R, S66N | 1.3 | 1.2 |
| L27V, K43R, Y68D | 1.6 | 1.5 |
| L27V, Y68D | 1.7 | 1.4 |
| L27V, K43R, S66N | 1.2 | 1.0 |

D. L27V

Figure 50:
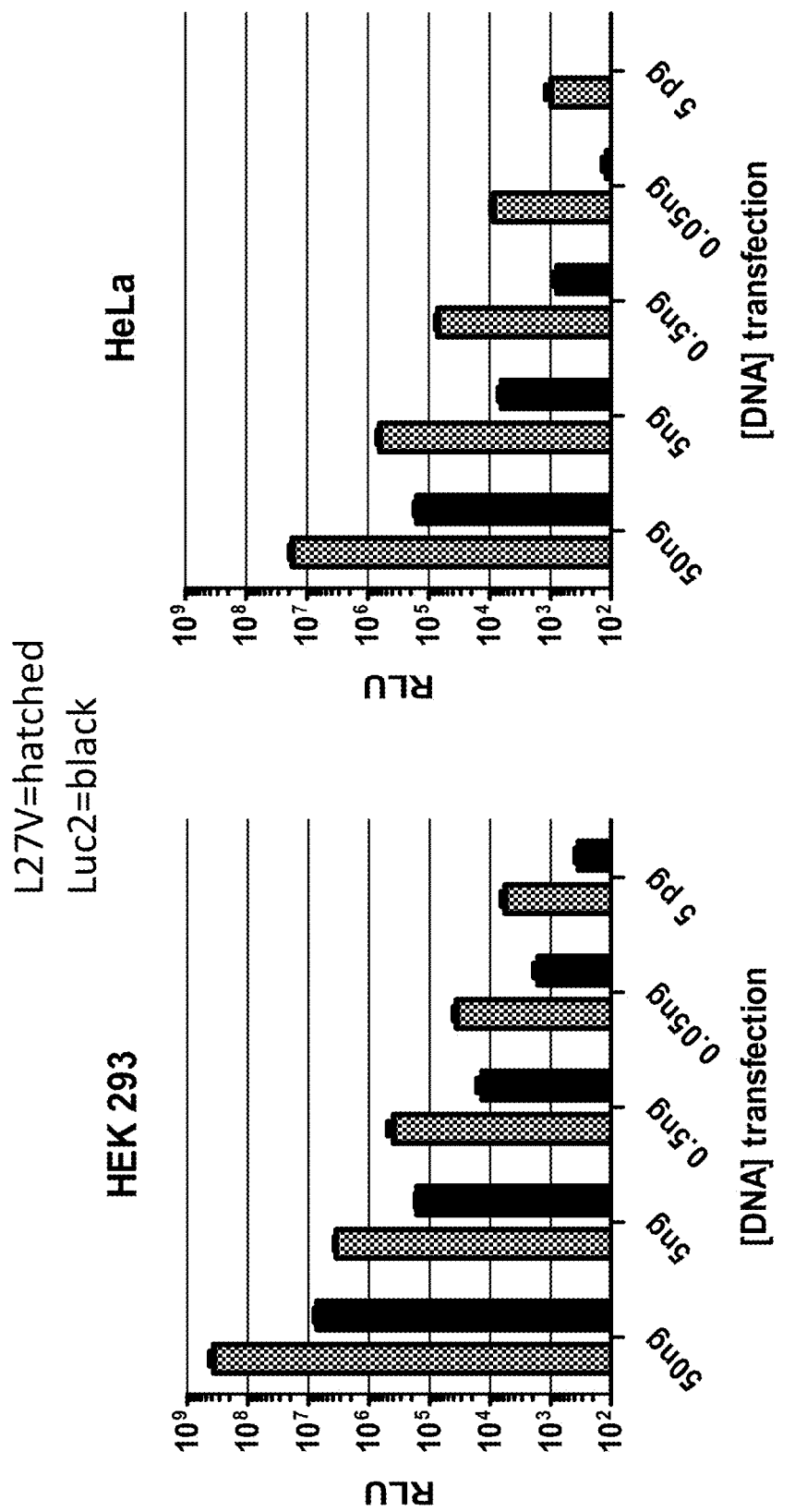
FIGS. 50A-E show the luminescence of the OgLuc variant L27V compared to firefly luciferase (Luc2) in HEK 293 (FIG. 50A) and HeLa cells (non-fusion) (FIG. 50B), the luminescence of HaloTag® fusion compared to the OgLuc variant L27V (FIG. 50C) and firefly luciferase (Luc2) (FIG. 50D), and the protein expression of HaloTag®-OgLuc L27V compared to HaloTag®-Firefly luciferase (Luc2) in HEK 293 ("HEK") and HeLa cells ("HeLa").
Figure 50:
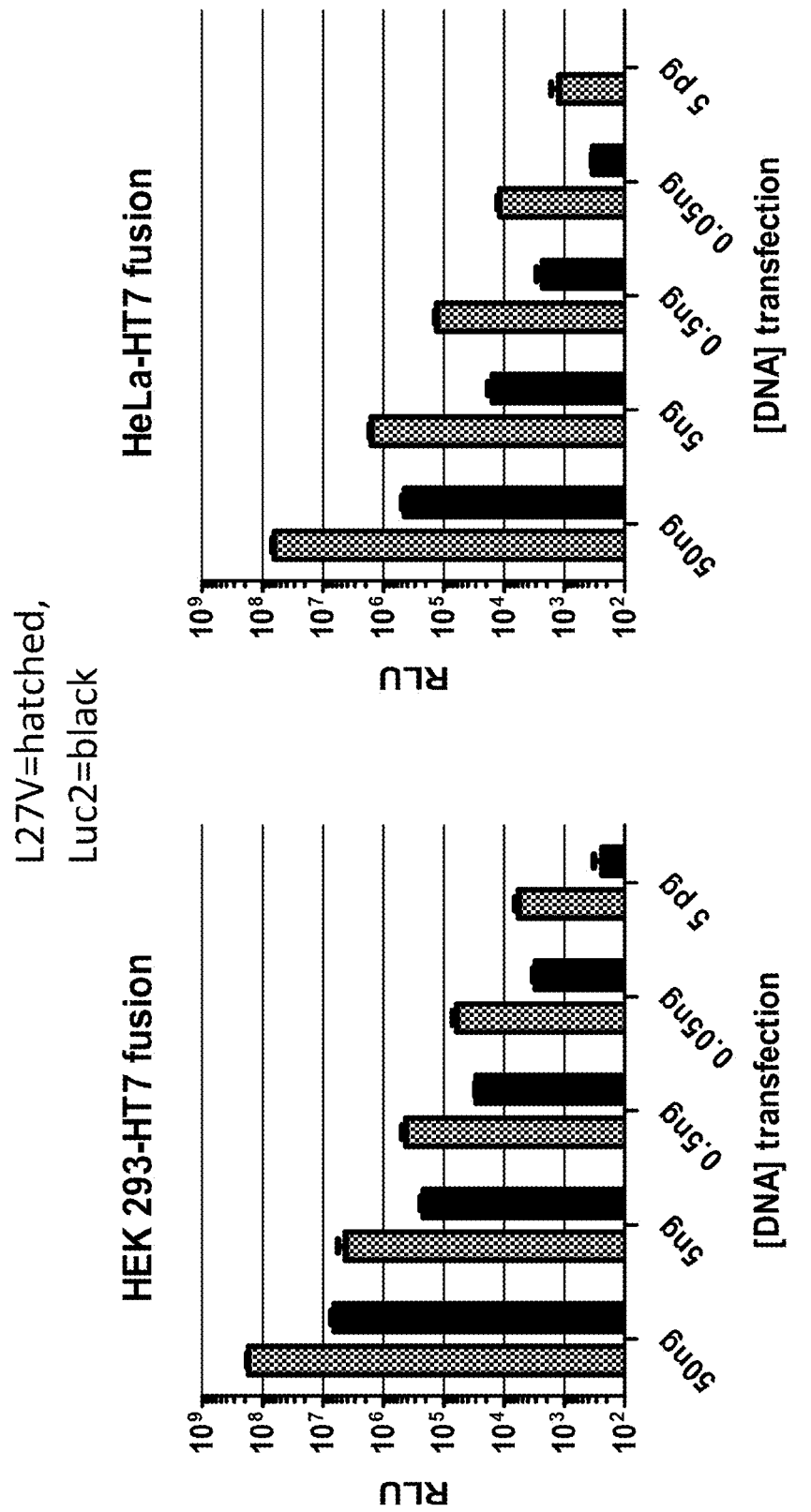
Figure 50:
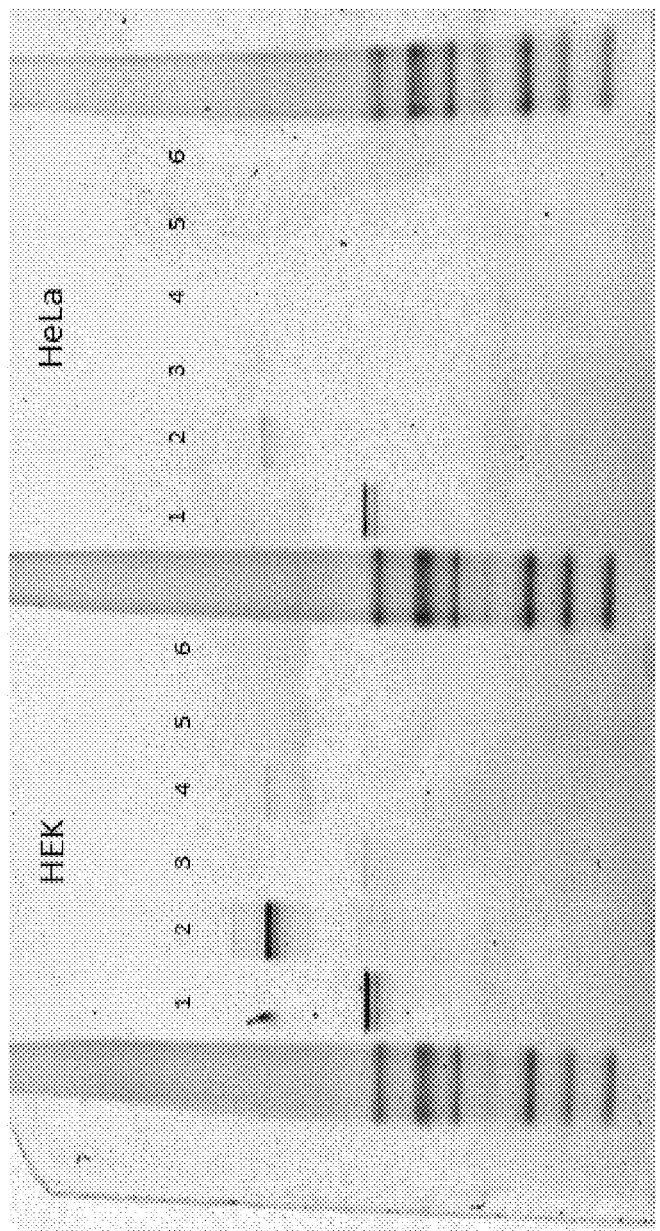

A comparison of the luminescence of the L27V variant to firefly luciferase alone and as a fusion was performed. HEK293 and HeLa cells were plated at 15,000 and 10,000 cells/well, respectively, into wells of 12-well plates and incubated overnight at 37° C., 5% $CO_2$. The cells were then transfected with serial dilutions of pF4Ag containing L27V or Luc2. 20 ng of pGL4.13 (Promega Corp.) was co-transfected with L27V, and 20 ng of pGL4.73 (Promega Corp.) was co-transfected with Luc2 to act as carrier DNA for lower dilutions of the L27V or Luc2 plasmid DNA. The plasmid DNA was then transfected into the cells (6 replicates for each dilution for each cell type) using TRANSIT®-LTI transfection reagent according to the manufacturer's instructions. The cells were then incubated for 24 hrs at 37° C., 5% $CO_2$ After transfection, the media was removed from the cells, and 100 µL PBS with 0.5% TERGITOL® NP-9 (v/v) added and shaken for 10 min at room temperature. 10 µL of each cell lysate was assayed using ONE-GLO™ Luciferase Assay System (Promega Corp.; Luc2) or assay reagent (Example 22H with 20 µM PBI-3939; OgLuc). Luminescence was measured as previously described for the HEK293 (FIG. 50A) and HeLa cells (FIG. 50B).

Comparison of L27V and Luc2 as fusion partners was performed as described above. L27V and Luc2 were fused to HALOTAG® protein in pF4Ag. FIGS. 50C-D show the luminescence measured with the different fusions in HEK293 (FIG. 50C) and HeLa cells (FIG. 50D).

In addition to measuring luminescence, protein expression was also analyzed. The transfection was performed as described above. After transfection, the media was removed from the cells, and the cells washed in 1×PBS. 100 µL 0.1× Mammalian Lysis Buffer (Promega Corp.) containing 1 µM HALOTAG®TMR ligand (Promega Corp.) and 20 U DNase I was added, and the cells incubated with slow shaking for 45 min at room temperature. The cell samples were then frozen at −20° C. For protein analysis, 32.5 µL 4×SDS loading dye was added to each sample, and the samples heated at 95° C. for 2 min. 10 µL of sample was then loaded onto an SDS-PAGE gel and imaged on a Typhoon Scanner as previously described (FIG. 50E).

Example 32—Brightness of Purified OgLuc Variant Compared to Firefly Luciferase

The 9B8 OgLuc variant was overexpressed and purified as described in Example 33. Reactions between diluted enzyme and substrate were performed using the following 2× buffer/assay reagent: 100 mM MES pH 6.0, 1 mM CDTA, 150 mM KCl, 35 mM thiourea, 2 mM DTT, 0.25% TERGITOL® NP-9 (v/v), 0.025% MAZU® DF 204, 10 mg/mL 2-hydroxy-β-cyclodextrin, and 20 µM PBI-3939. The final assay concentrations of purified enzyme and substrate were 0.5 pM and 10 µM, respectively. In parallel, reactions between diluted purified firefly luciferase (i.e., QUANTILUM® Recombinant Luciferase (Promega Corp.)) and luciferin were analyzed. The assay buffer/reagent for the firefly luciferase reaction was BRIGHT-GLO™, and the final assay concentrations were 0.5 µM enzyme and 500 µM luciferin. As the buffers/reagents for each reaction were known to provide "glow" kinetics, a 15 min time point was used to collect luminescence data. The results from this experiment showed that 9B8 opt using PBI-3939 (19,200 RLU) was approximately 8-fold brighter than QUANTILUM® Recombinant Luciferase with BRIGHT-GLO™ (2,300 RLU).

Example 33—Inhibition Analysis

To determine the susceptibility of the OgLuc variants to off-target interactions, the activity of the 9B8 and L27V variants was screened against a LOPAC (library of pharmacologically active compounds) library. A LOPAC 1280 library (Sigma) was prepared by diluting the compounds to 1 mM in DMSO. On the day of the assay, the compounds were diluted to 20 µM in 1×PBS, and 10 µL transferred to a 96-well, white plate. To each well, 10 µL of purified 9B8, L27V or firefly luciferase (Luc2) enzyme diluted $10^{-4}$ in Glo Lysis Buffer (Promega Corp.) was added and incubated at room temperature for 2 min. To the samples, 20 µL assay reagent (1 mM CDTA, 150 mM KCl, 2 mM DTT, 100 mM MES pH 6.0, 35 mM Thiourea, 0.5% TERGITOL® NP-9 (v/v) and 60 µM PBI-3939) was added, incubated for 3 min, and luminescence measured on a TECAN® GENIOS™ Pro Luminometer. For assaying firefly luciferase, the BRIGHT-GLO™ Assay reagent (Promega Corp.) was used according to the manufacturer's protocol. As a negative control, 8 wells of each plate contained 1×PBS+2% glycerol. As a positive control, 8 wells of each plate contained 2 mM Suramin in 2% DMSO or 2 mM luciferase inhibitor 1 in 2% DMSO (Calbiochem). Suramin was identified in the preliminary screen of the LOPAC library (i.e., the LOPAC library was screened using the 9B8 variant with a lower substrate concentration of 20 µM) to be an inhibitor of OgLuc.

Figure 51:
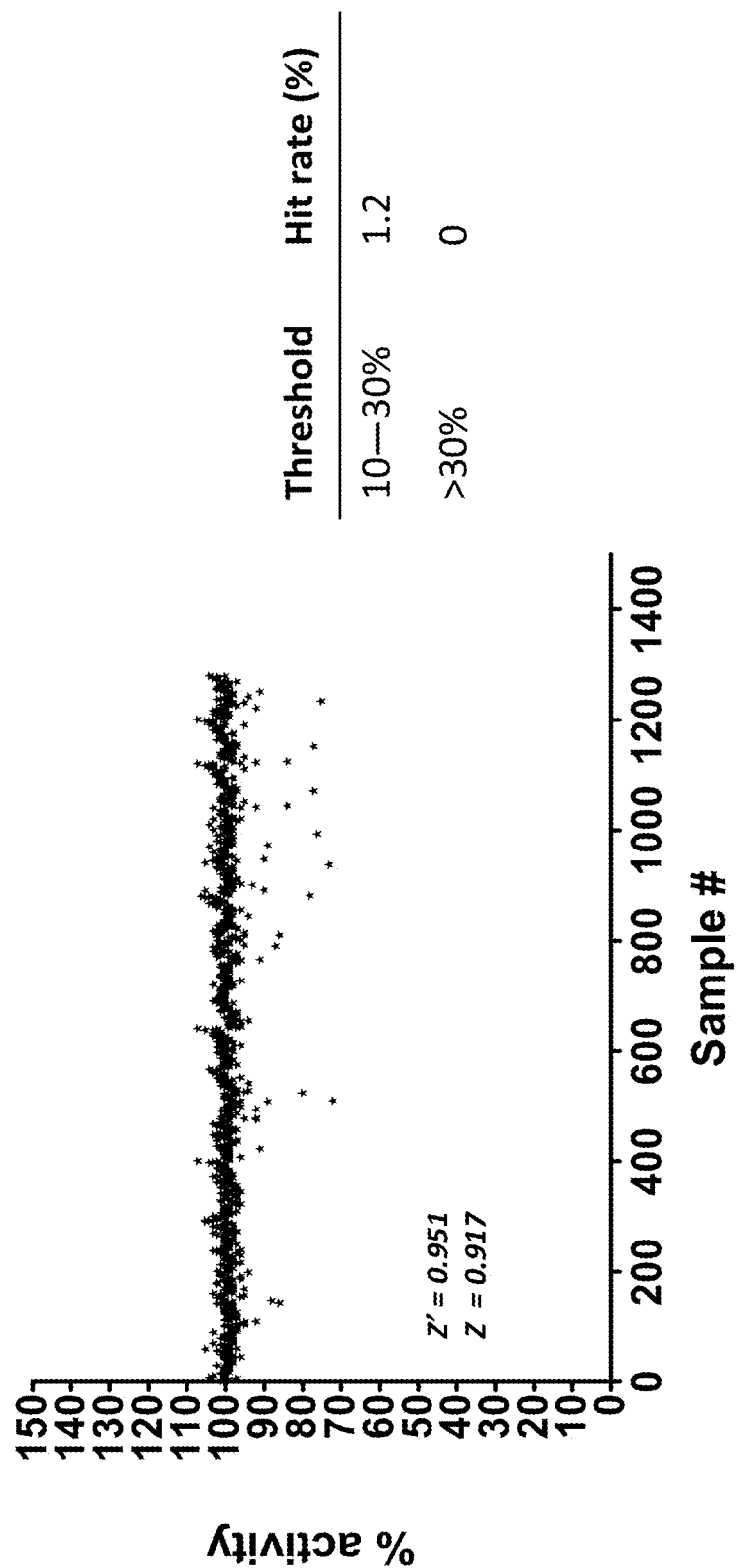
FIG. 51 shows inhibition analysis of the OgLuc variants 9B8 and L27V against a LOPAC library to determine their susceptibility to off-target interactions.

The results in FIG. 51 indicate a general low frequency of off-target interactions between the compounds in the LOPAC library and L27V. This suggests a potential use for L27V as a screening tool for large libraries of diverse chemicals and therapeutic candidates, including live cell-based formats (e.g., high-throughput screening).

Figure 52:
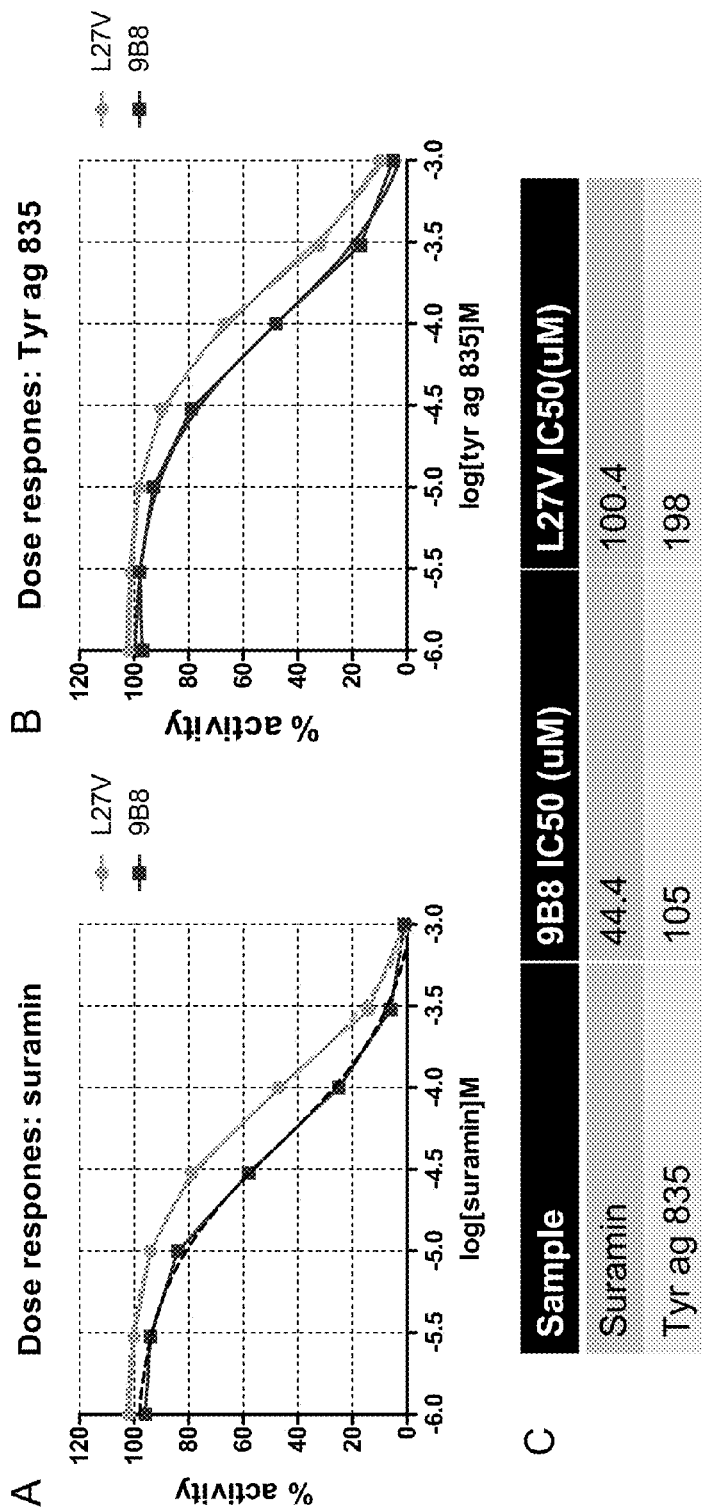
FIGS. 52A-E show the inhibition analysis of the OgLuc variants 9B8 and L27V by Suramin and Tyr ag 835 (FIGS. 52A-C) and the chemical structures of Suramin (FIG. 52D) and Tyr ag 835 (FIG. 52E).

To further examine inhibition resistance, purified 9B8 and L27V were screened against various concentrations of Suramin (Sigma S-2671) and Tyrphostin AG 835 ("Tyr ag 835") (Sigma T-5568) (FIGS. 52A-C). FIGS. 52E-D show the chemical structures for Suramin and Tyr ag 835, respectively. Purified 9B8 and L27V were prepared as described above. Serial dilutions (0, 2 µM, 6 µM, 20 µM, 60 µM, 200 µM and 2 mM) of the inhibitors were prepared in 1×PBS with 2% DMSO. To wells of a 96-well, white assay plate, 10 µL of diluted enzyme and 10 µL of diluted inhibitor were added and incubated at room temperature for 2 min. 20 µL assay reagent (described above) was added, and luminescence measured on a GLOMAX®-96 luminometer (FIGS. 52A-C). FIGS. 52A-B show the dose response curves of 9B8 and L27V to Suramin (FIG. 52A) and Tyr ag 835 (FIG. 52B). FIG. 52C shows the half maximal inhibitory concentration ($IC_{50}$) of Suramin and Tyr ag 835 for 9B8 and L27V. The data indicates that L27V is a robust reporter that could be used as a screening tool for large libraries of diverse chemicals and/or therapeutic candidates.

Example 34—Resistance to Non-Specific Protein Interactions

1. Purified 9B8 and L27V enzyme were serial diluted in 1:10 in buffer (1×PBS, 1 mM DTT, and 0.005% IGEPAL® CA-630) with or without 0.5 mg/mL BSA (4 sets of each dilution) to 200 µL into PCR strip tubes. The samples were incubated at 60° C. wherein at 0, 2, 4, and 6 hrs one set of dilutions for each variant was transferred to −70° C.

Figure 53:
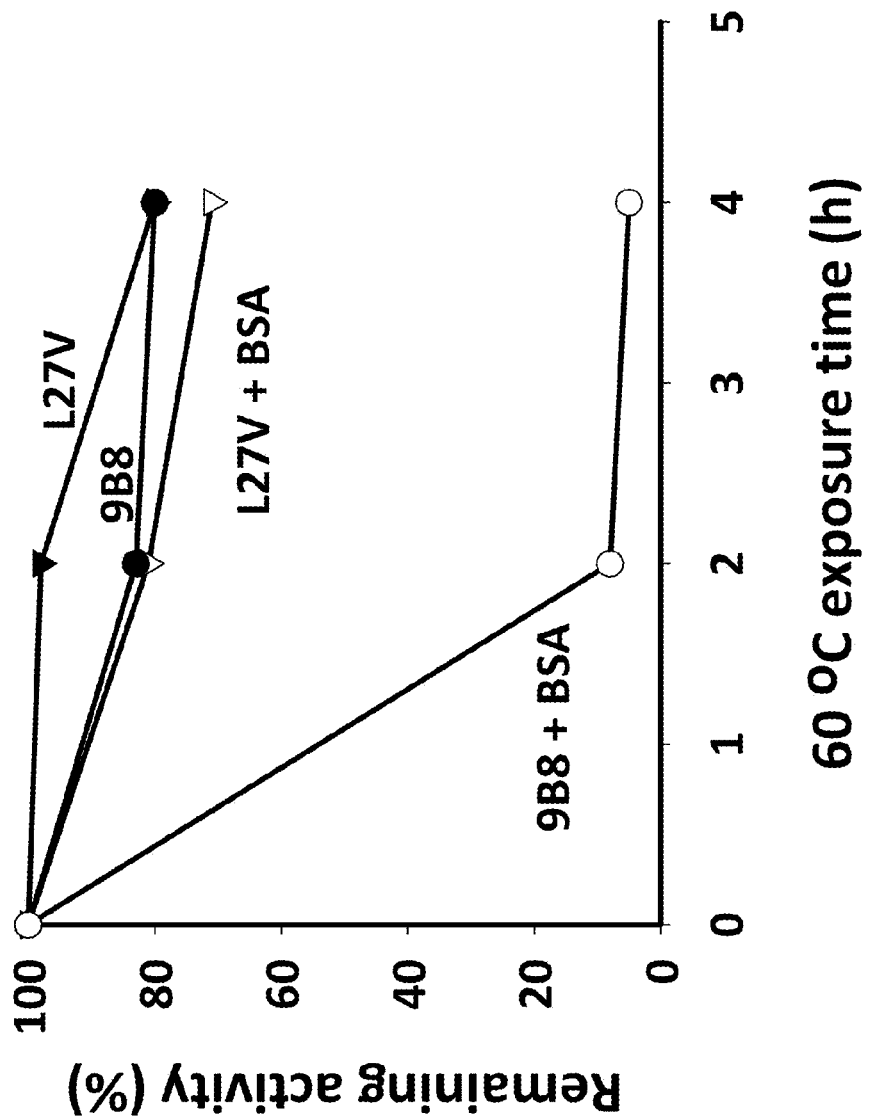
FIG. 53 shows the activity of the OgLuc variants 9B8 and L27V was analyzed in the presence of BSA to determine resistance to non-specific protein interactions.

To analyze activity, the samples were thawed to room temperature in a water bath. 50 µL assay reagent (as previously described with 100 µM PBI-3939) was added, and luminescence measured for each minute for 30 min on a TECAN® INFINITE® F500 plate reader. Activity was calculated using the average luminescence of the $1 \times 10^6$ and $1 \times 10^7$ dilutions (FIG. 53).

2. To demonstrate the reactivity of the OgLuc variants to plastic, purified 9B8 and L27V were exposed to polystyrene plates, and their activity measured.

Figure 54:
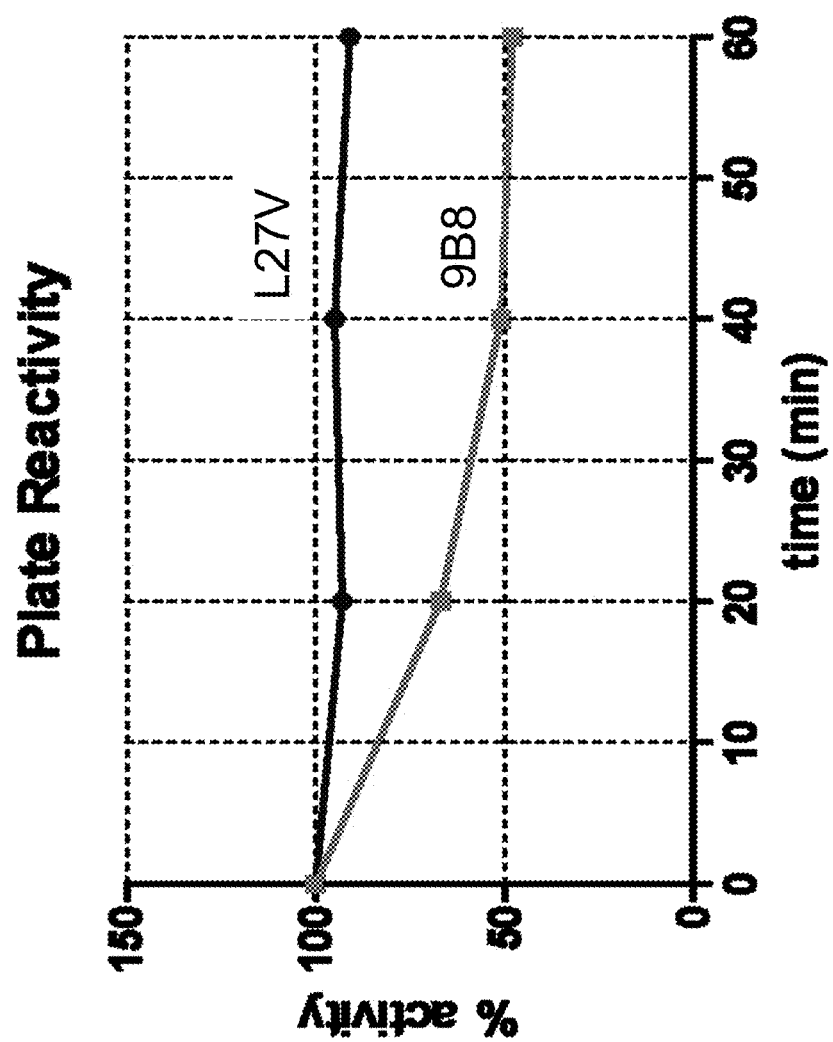
FIG. 54 shows the percent activity of the OgLuc variants 9B8 and L27V to determine reactivity to plastic.

50 µL purified 9B8 (45.3 µM) and L27V (85.9 µM) in DMEM without phenol red with 0.1% PRIONEX® was placed into wells of a 96-well, polystyrene microtiter plate at 60, 40, 20 and 0 min. To the samples, 50 µL assay reagent (described above) containing 20 µM PBI-3939 was added and incubated for 5 min at room temperature. Luminescence was measured as previously described, and percent activity determined (FIG. 54; ratio of luminescence to time 0).

Example 35—Post Translational Modification

To determine if the OgLuc variants undergo any post translation modifications when expressed in mammalian cells, the 9B8 and L27V variants were expressed in both mammalian cells and E. coli and analyzed via mass spectrometry (MS).

9B8 and L27V variants were expressed as N-terminal HALOTAG® fusions (pFN18K for E. coli; pFN21K for HEK293 cells) in HEK293 and E. coli KRX (Promega Corp.) cells and purified using the HALOTAG® Protein Purification System (Promega Corp.) according to the manufacture's instructions. Approximately 5 pmols of purified enzyme was analyzed via LC/MS using a C4 column (Waters Xbridge BEH300, 3.5 µm) interfaced to an LTQ Orbitrap Velos mass spectrometer (Thermo Scientific). Data was acquired from 600-2000 m/z using the LTQ for detection and processed using the MagTran v1.03 software (Zhang et al., *J. Am. Soc. Mass Spectrom.*, 9:225-233 (1998)). Both purified enzymes had an experimentally determined mass of 19,666 Da, compared to a calculated mass of an un-modified OgLuc variant, i.e., absent of any post translational modifications, of 19,665 Da.

Example 36—Evaluation of OgLuc Variants as a Transcriptional Reporter

A. IV

The use of the OgLuc variants as a transcriptional reporter was examined. To generate a transcriptional reporter of cAMP, hRL and IV were sub-cloned using methods known in the art into a modified pGL4 vector (Promega Corp.) containing a barnase sequence, which was replaced by the DNA fragment of interest. The leader sequence of the modified pGL4 contained a minimal promoter and a cAMP-response element (CRE; SEQ ID NO: 96), so that upon stimulation with a cAMP agonist such as forskolin (FSK), cells accumulating cAMP activated the reporter and generated luminescence. In this experiment, 2 ng DNA of either the hRL or IV transcriptional reporter construct was used to transfect HEK293 cells as described in Example 25. At 24 hrs post transfection, the cells were treated with 100 μM FSK. Cells that were not treated with FSK were used as a control. After 6 hrs, a reporter reagent was added to treated and control cells. For hRL, the reporter reagent was *Renilla*-Glo™ reagent (Promega Corp.). For IV, the reporter reagent contained 1 mM CDTA pH 5.5, 150 mM KCl, 10 mM DTT, 0.5% TERGITOL® NP-9 (v/v), 20 μM coelenterazine-h, and 150 mM thiourea. After 10 min, luminescence was read on a Varioskan® Flash (Thermo Scientific).

Figure 55:
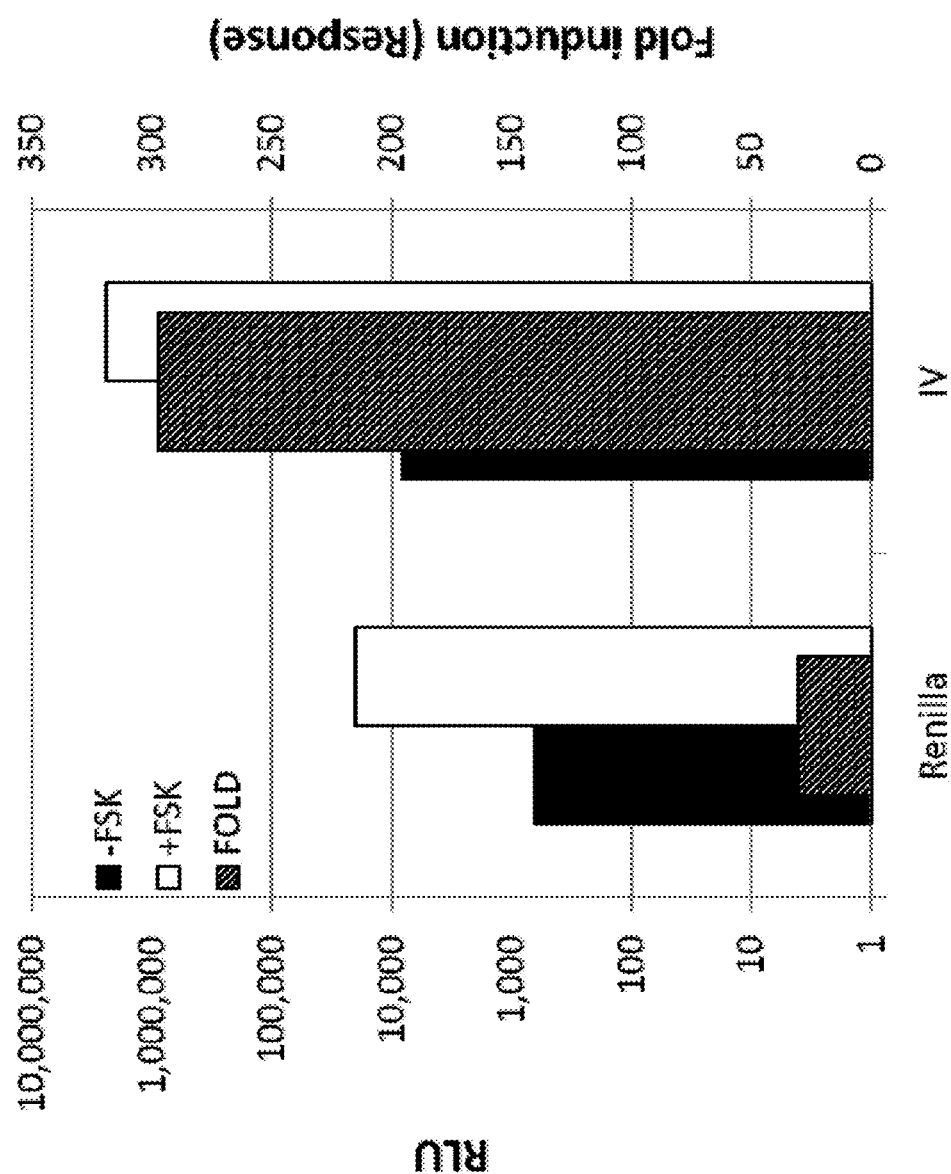
FIG. 55 shows the luminescence generated from lysed HEK293 cells expressing the IV cAMP transcriptional reporter compared to hRL ("Renilla") using known coelenterazine-h as a substrate with ("induced") or without ("basal") forskolin treatment and the fold induction (response) due to forskolin treatment ("fold").

FIG. 55 shows the normalized luminescence of HEK293 cells containing the hRL ("*Renilla*") or IV transcriptional reporter treated ("+FSK") or not treated ("−FSK") with FSK. The response, i.e., fold-induction or fold-increase ("FOLD") in luminescence was determined by dividing the luminescence from the treated cells (+FSK) with the luminescence from the control cells (−FSK). As shown in FIG. 55, the response for hRL was <50, while for IV it was >300, demonstrating the use of IV as a transcriptional reporter.

B. 9B8 and 9B8 Opt

The use of variants 9B8 and 9B8 opt as a transcriptional reporter was also examined and compared to hRL and Luc2 transcriptional reporters as previously described for the IV transcriptional reporter with the following modifications. Transcriptional reporters of cAMP containing either variants 9B8 or 9B8 opt were generated as described above. After 6 hrs of FSK induction, the media was removed from the cells and replaced with 10 μL of the lysis buffer described in Example 25 creating a lysate. The lysate of transfected cells treated with or without FSK were assayed for luminescence as described in Example 25. 10 μL of the Luc2 lysate was assayed with 50 μL of BRIGHT-GLO™ Luciferase Assay Reagent. 10 μL of the hRL lysate was assayed with 50 μL of lysis buffer containing 20 μM native coelenterazine. 10 μL of the variants 9B8 and 9B8 opt lysates were assayed with 50 μL of lysis buffer containing 20 μM PBI-3939.

FIG. 56 shows the normalized luminescence of HEK293 cells containing the 9B8, 9B8 opt, hRL, or Luc2 transcriptional reporter treated ("induced") or not treated ("basal") with FSK. The response, i.e., fold-induction or fold-increase ("fold") in luminescence, was determined by dividing the induced luminescence by the basal luminescence (FIG. 56). Although the fold induction values are similar for each of the reporters except Luc2, the luminescence generated by the induced 9B8 opt transcriptional reporter was approximately 2.5 logs higher than the induced *Renilla* transcriptional reporter and approximately 1.5 logs higher than the Luc2 transcriptional reporter. FIG. 56 demonstrated the use of 9B8 and 9B8 opt as transcriptional reporters.

C. 9B8 Opt and 9B8 Opt+K33N

Figure 57:
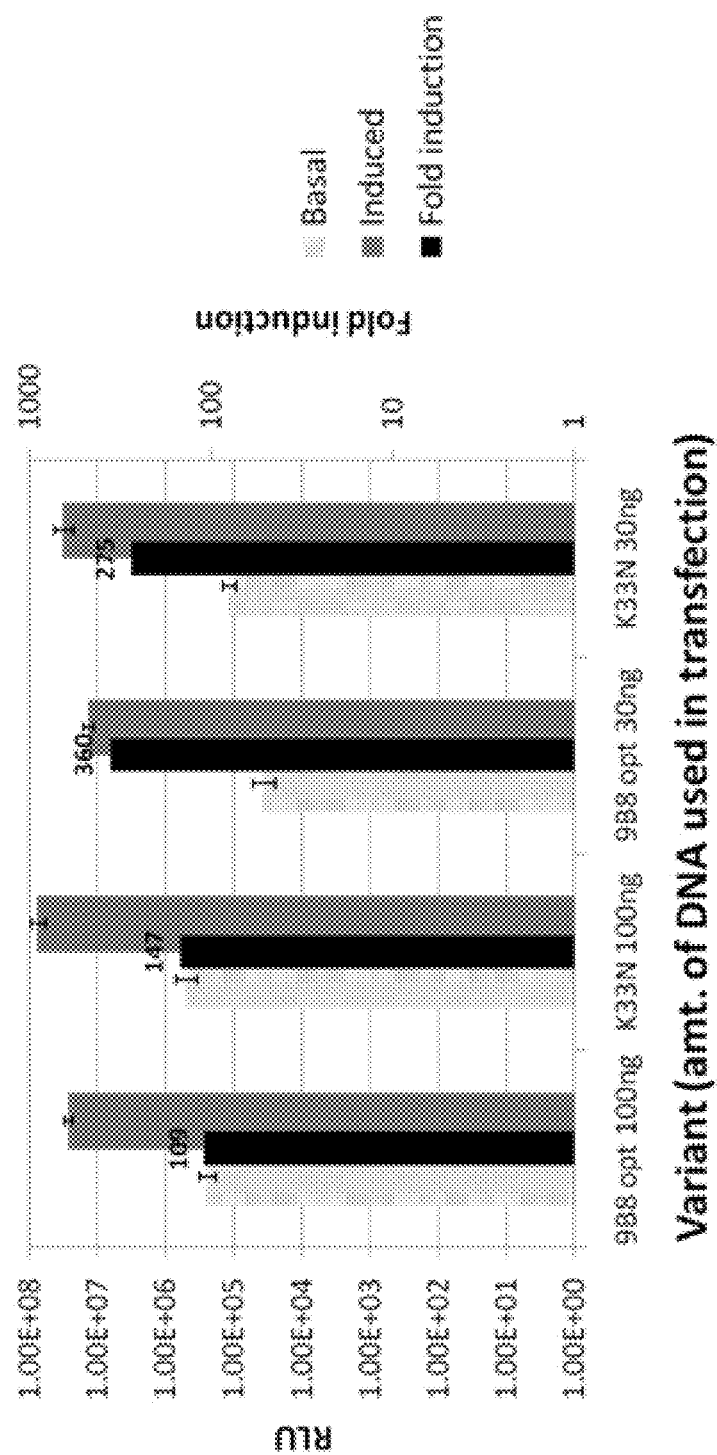
FIG. 57 shows the luminescence generated from lysed HEK293 cells expressing 9B8 opt and 9B8 opt+K33N ("K33N") cAMP transcriptional reporters using the novel coelenterazine PBI-3939 as a substrate with ("Induced") or without ("Basal") forskolin treatment and the fold induction due to forskolin treatment ("Fold Induction").

The variants 9B8 opt and 9B8 opt+K33N were compared in a lytic transcriptional reporter assay. The variant 9B8 opt+K33N was cloned using methods known in the art into a pGL4.29 vector (Promega Corp.), which contains a cyclic AMP response element (CRE). The 9B8 opt+K33N transcriptional reporter was tested and compared to the 9B8 opt transcriptional reporter as described above in HEK293 cells. 30 and 100 ng of plasmid DNA containing the transcriptional reporter versions of the variants were used to transfect HEK293 cells. The cells were induced with FSK for 5 hrs prior to measurement for luminescence. Cells were lysed with a lysis buffer containing 1 mM CTDA, 150 mM KCl, 2 mM DTT, 100 mM MES pH 6.0, 35 mM thiourea, 0.25% TERGITOL® NP-9 (v/v), and 10 mg/mL 2-hydroxypropyl-β-cyclodextrin. Luminescence was measured on a TECAN® GENIOS™ Pro luminometer. The lysate was assayed with the lysis buffer containing 20 μM PBI-3939. FIG. 57 shows the normalized luminescence (transfection corrected) of HEK293 cells expressing the 9B8 opt or 9B8 opt+K33N transcriptional reporter construct treated ("Induced") or not treated ("Basal") with FSK. As shown in FIG. 57, the fold-induction for 9B8 opt was 360 when 30 ng of DNA was used for transfection and 109 when 100 ng was used for transfection, while the fold-induction for 9B8 opt+K33N was 275 and 147, respectively. When higher amounts of DNA were used for transfection, K33N provided a greater response.

D. L27V

Figure 58:
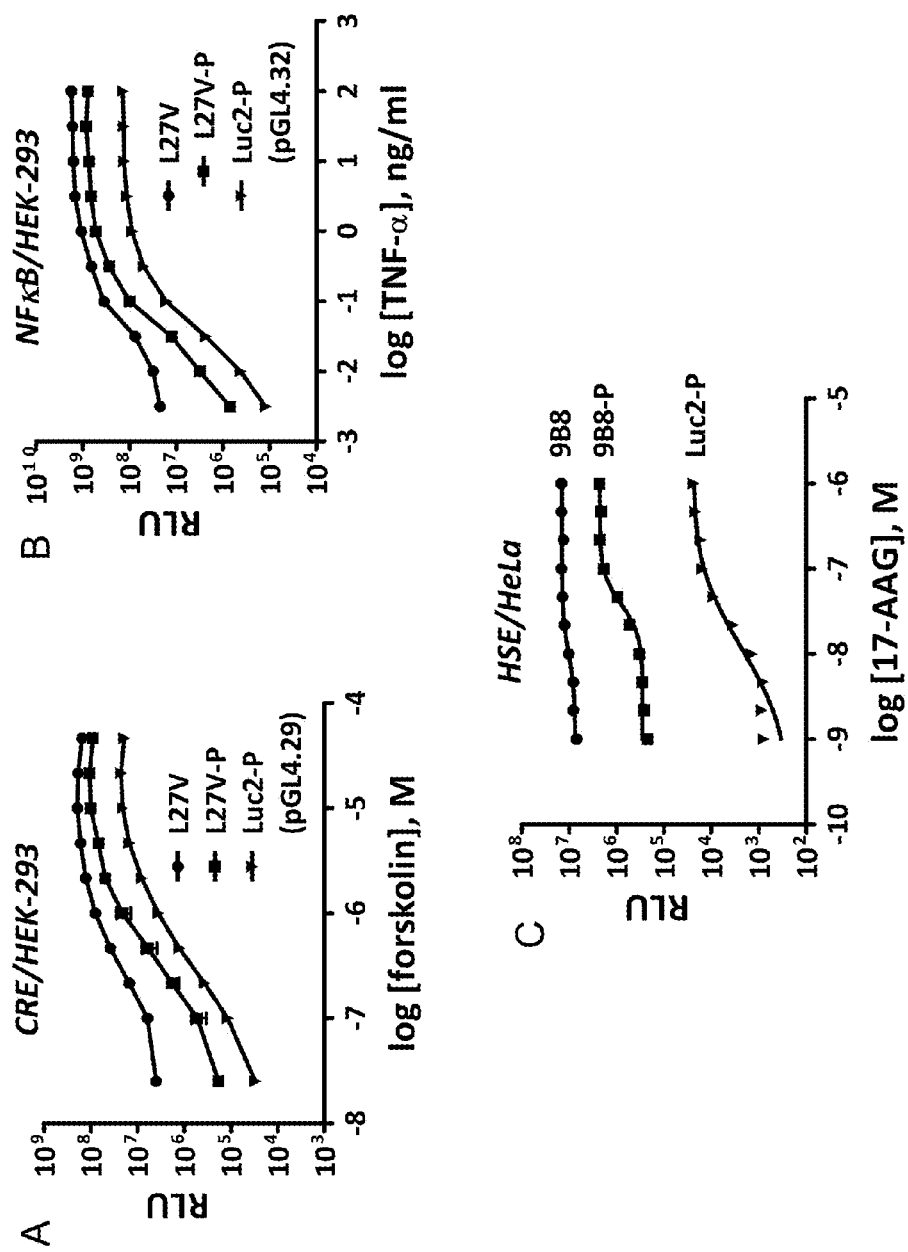
FIGS. 58A-C show the luminescence of the OgLuc variants 9B8 and L27V lytic reporter constructs for multiple pathways in multiple cell types.

1. L27V was cloned into a reporter vector as described in C of this Example containing a CRE, NFkB or HSE (Heat shock element) response element. Reporter constructs were then transfected into HEK293 cells or HeLa cells as previously described. The cells were then induced using FSK for CRE, TNFα for NFkB or 17-AAG for HSE. Luminescence was measured as previously described using the assay reagent with 20 μM PBI-3939 (FIGS. 58A-C). The reporter constructs were all validated in HEK293, HeLa, NIH3T3, U2OS and Jurkat cell lines (data not shown).

2. L27V02 and L27V02P (containing a PEST sequence; SEQ ID NO: 323) were cloned into a reporter vector (pGL4.32 based) as described in C of this Example. Other OgLuc variants containing a PEST sequence include L27V01-PEST00 and L27V03-PEST02 (SEQ ID NOs: 320 and 326, respectively). The reporter construct was then transfected into HEK293 cells as previously described. The cells were then induced using FSK, and luminescence was measured as previously described using the assay reagent with 20 μM PBI-3939 (FIGS. 59A-B). Various other reporter constructs were also created and tested in various cell lines (FIG. 59C).

Figure 59:
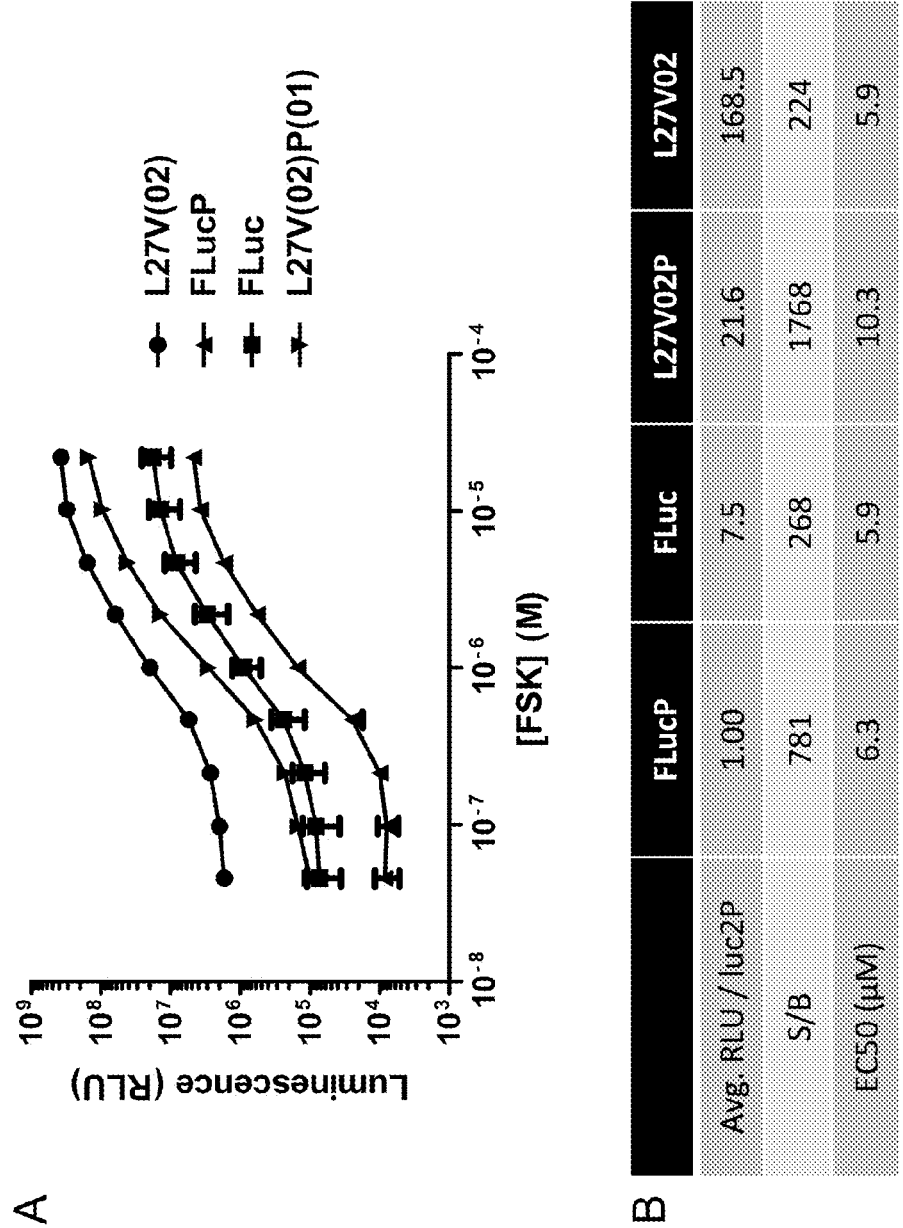
FIGS. 59A-C show the luminescence of the OgLuc variant L27V reporter constructs in various cell lines and with various response elements.

FIG. 59A shows the full dose response for the CRE system in HEK293 cells. FIG. 59B summarizes FIG. 59B. FIG. 59C summarizes the data in FIGS. 59A-B and shows the same type of data for the NFkB response element. Both CRE and NFkB report constructs were examined in HEK293, HeLa, HepG2, Jurkat, ME180, HCT116, and U2OS cell lines.

Figure 60:
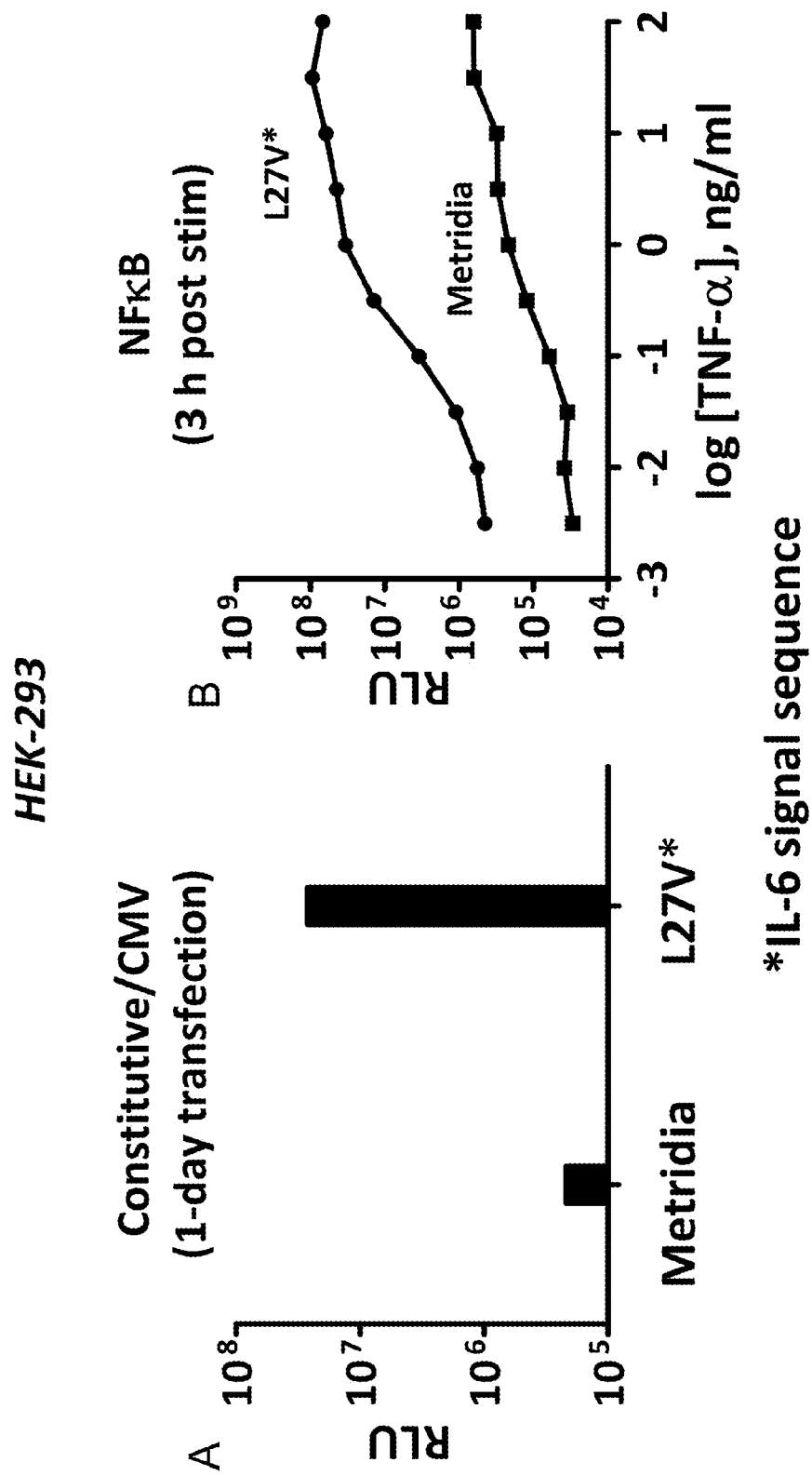
FIGS. 60A-B show the luminescence of the OgLuc variant L27V secretable reporter compared to Metridia longa luciferase with a CMV promoter (FIG. 60A) or a NFkB response element (FIG. 60B).

3. HEK293 cells ($0.9 \times 10^6$ cells in a T25 flask) were transfected with pNFkB-L27V secretion construct (SEQ ID NOS: 463 & 464; wherein the IL-6 secretion sequence (SEQ ID NOs: 461 and 462) replaced the native OgLuc secretion sequence SEQ ID NO: 54), Metridia longa (Clontech), pNFkB-L27V (native secretion sequence; SEQ ID NOs: 465 and 466) or firefly luciferase (Luc2; pGL4.32-based) plasmid DNA using FUGENE® HD (Promega Corp.) according to the manufacturer's instructions. Cells were incubated at 37° C., 5% $CO_2$ for 8 hrs, then trypsinized in 0.5 mL TrypLE (Invitrogen). The lysates were then resuspended in 8 mL DMEM with 10% FBS, 1×NEAA and 1× sodium pyruvate. 100 μL of the resuspended sample was then added to wells of a 96-well plate and incubated for 16 hrs at 37° C., 5% $CO_2$ Following incubation, the media was removed from the cells and replaced with 100 μL fresh media with our without TNFα (serially diluted). To assay for secretion, at 3 and 6 hrs, 5 μL of media (in triplicate) was removed from the cells, brought to 50 μL with PBS and mixed with 50 μL assay reagent (as previously described with 100 μM PBI-3939). Luminescence was measured at 0 and 10 min as previously described (FIG. 60).

For measuring Metridia longa luciferase activity, the Ready-To-Glow™ Secreted Luciferase System (Clontech) was used according to the manufacturer's protocol. Briefly, 5 μL Ready-to-Glow™ reagent was added to 5 μL of sample and 45 μL of PBS. Luminescence was measured immediately after reagent addition (FIG. 60).

E. L27V optimized variants.

Plasmid DNAs (pGL4.32-L27V00, pGL4.32-L27V01, pGL4.32-L27V02, pGL4.32-L27V03, and pGL4.13) were prepared for transfection using FUGENE® HD according to the manufacturer's protocol. The pGL4.32 vector (Promega Corp.) contains the NF-κB response element. The L27V codon optimized sequences replaced the Luc2P sequence in the vector. pGL4.13 vector (Promega Corp.) contains the Luc2 gene driven by the SV40 promoter.

Figure 61:
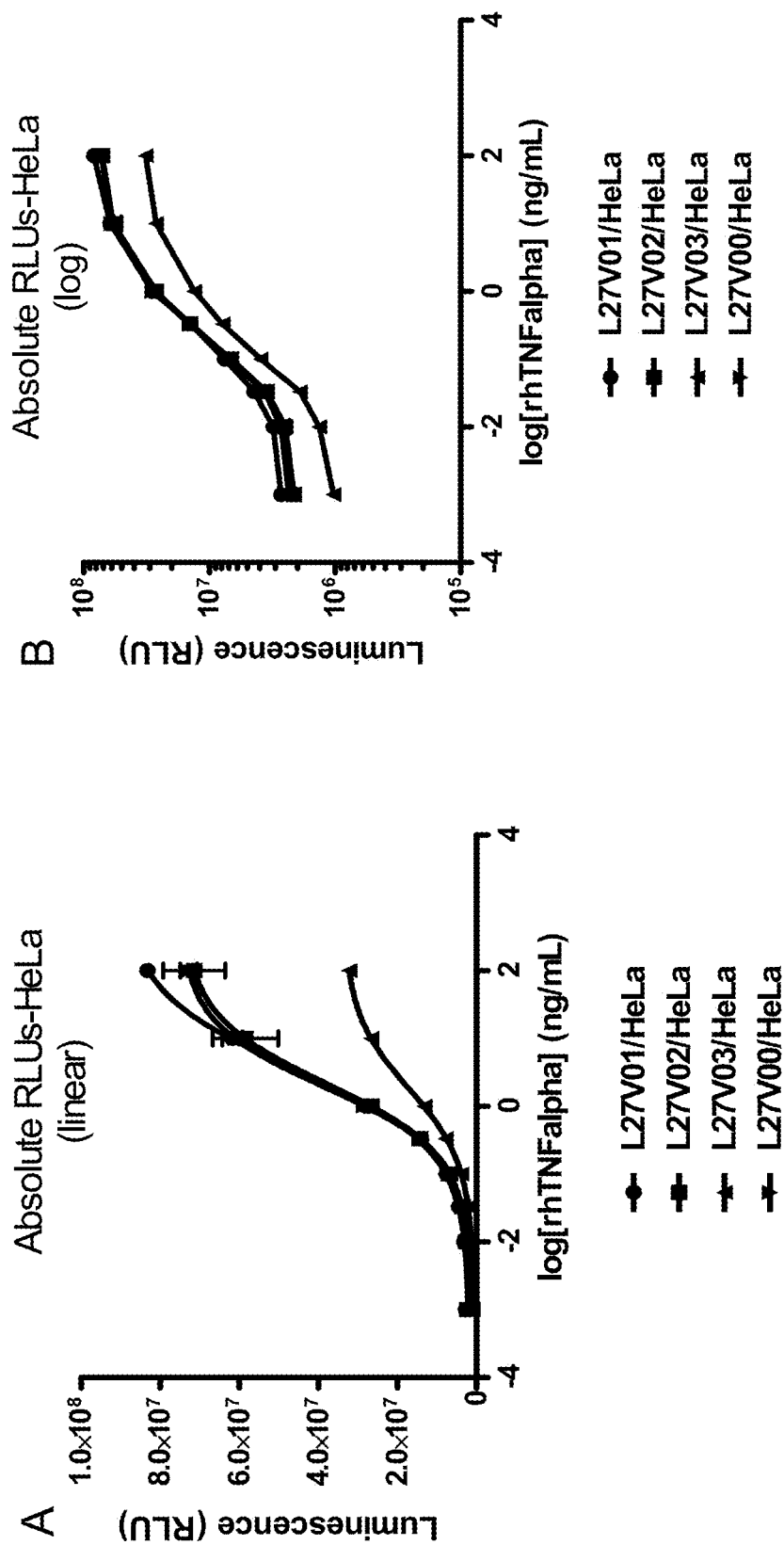
FIGS. 61A-F show the absolute luminescence (FIGS. 61A and 61B), the normalized luminescence (FIGS. 61C and 61D) and the fold response (FIGS. 61E and 61F) of optimized versions of L27V (L27V01, L27V02 and L27V03) compared to L27V (L27V00) expressed in HeLa cells.
Figure 61:
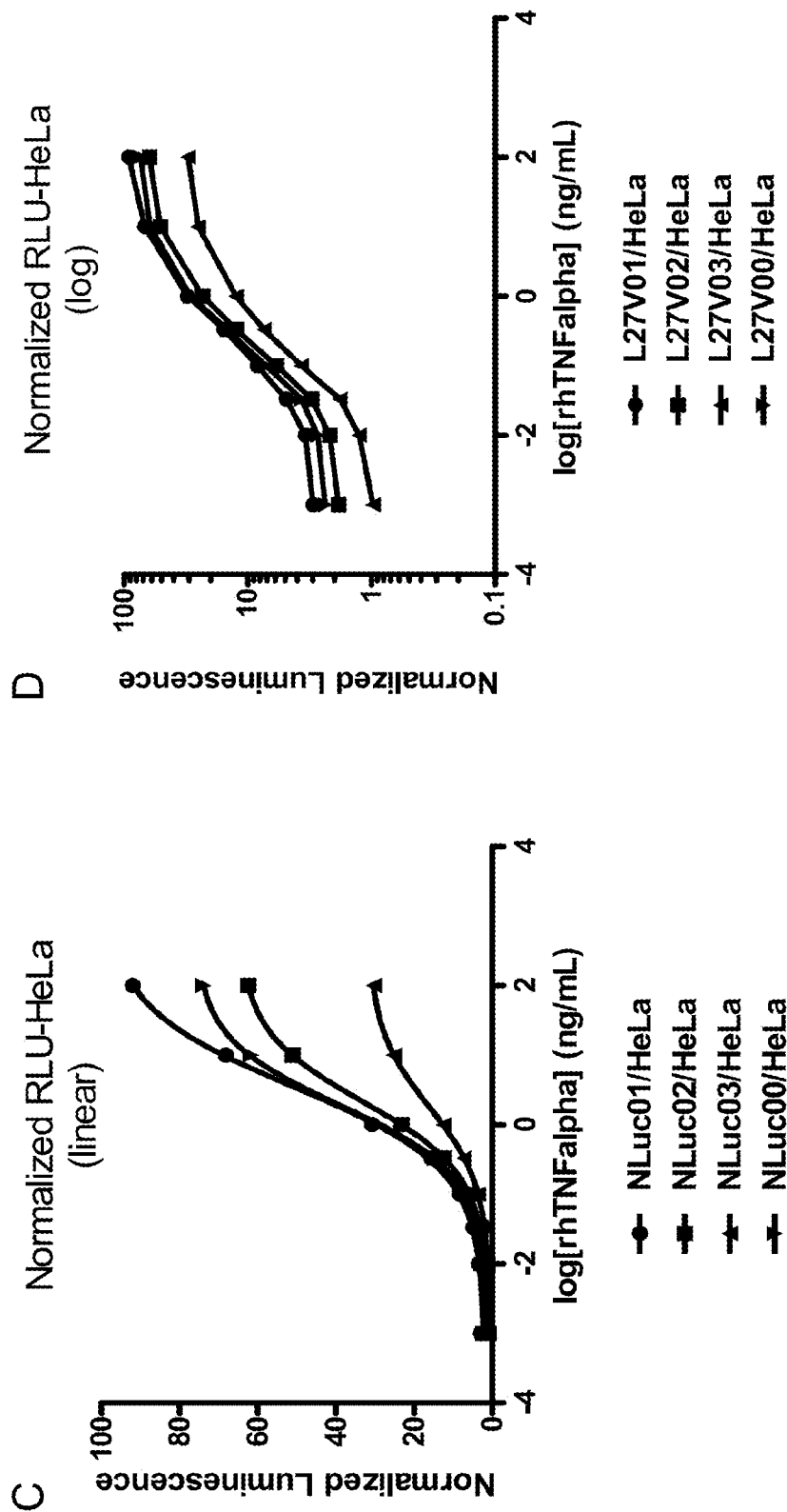
Figure 61:
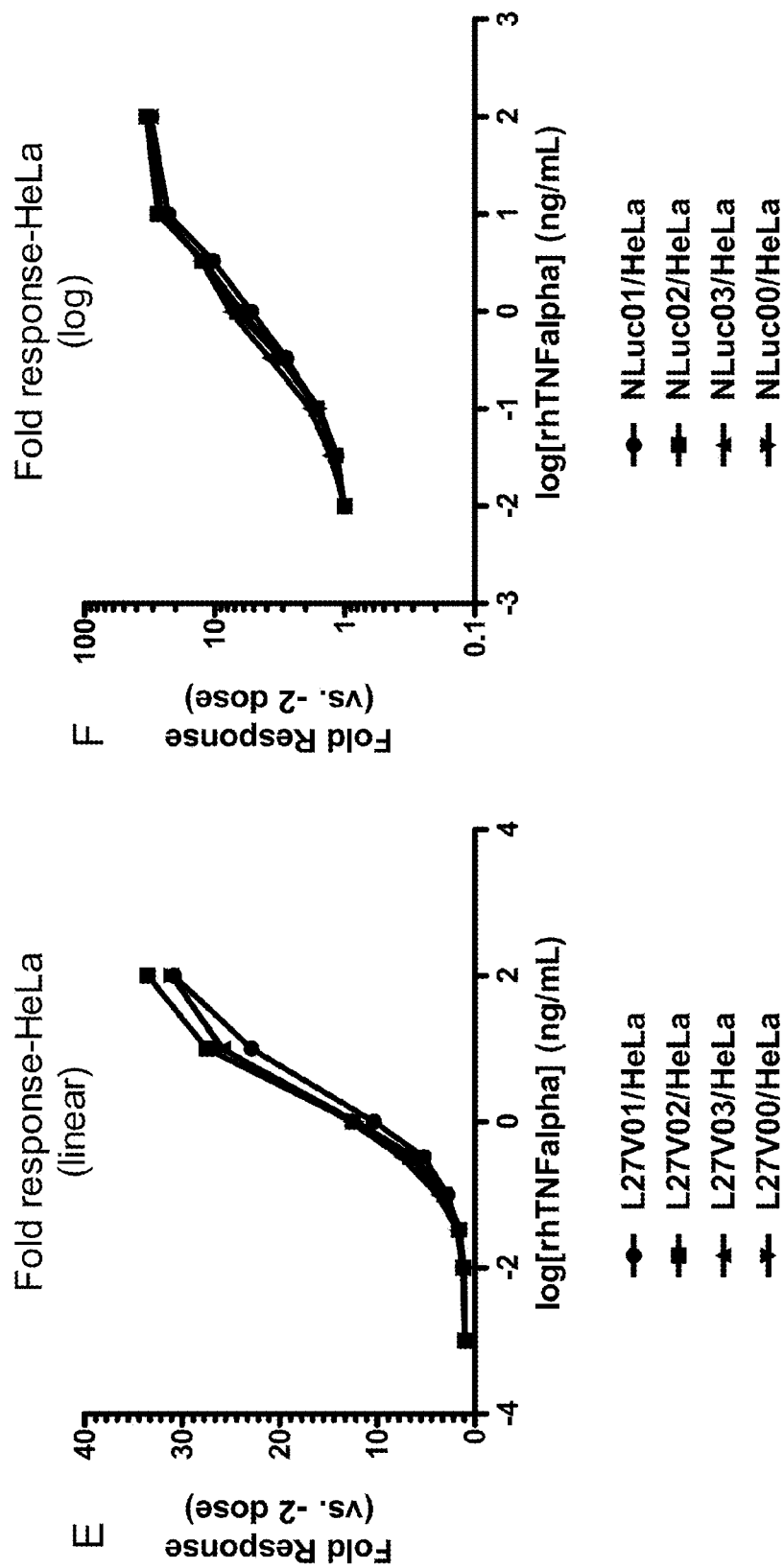

300 μL of DNA transfection mixture was then mixed with 6 mL of HeLa cell suspension ($2 \times 10^5$ cells/mL), homogenized, and 100 μL plated into wells of a 96-well plate. The cells were then incubated overnight at 37° C., 5% $CO_2$. Following incubation, 10 μL of 10× rhTNFα in DPBS with BSA was added to the wells and incubated for 4.5 hrs at 37° C., 5% $CO_2$. Six wells were given vehicle only. The cells were then allowed to equilibrate at room temperature for 20 min, and then 100 μL assay reagent (as previously described with 100 μM PBI-3939) was added. To cells expressing Luc2 or receiving vehicle only treatment, 100 μL of the ONE-GLO™ Luciferase Assay Reagent was added. Luminescence was measured 12 min post-assay reagent addition as previously described. FIGS. 61A-B shows the absolute luminescence, FIGS. 61C-D shows normalized luminescence and FIGS. 61E-F shows fold response.

Example 37—OgLuc Variants in a Transcription Reporter Assay

To demonstrate the ability of the OgLuc variants of the present invention to be used as transcription reporters, the OgLuc variant 9B8 opt was used as a transcriptional reporter in a forward, reverse, and bulk transfection. These methods of transfection were chosen because they are representative of the approaches commonly used for the transient expression of genetic transcriptional reporters.

Forward Transfection

Transcriptional reporters containing the cAMP response element (CRE) and 9B8 opt or 9B8 opt further comprising the PEST protein degradation sequence (9B8 opt-P) were prepared in the pGL4.29 (Promega Corp.) backbone, i.e., the luc2P gene of the pGL4.29 vector was replaced with 9B9 opt (SEQ ID NO: 24) or 9B8 opt-P (SEQ ID NO: 65). pGL4.29 was used as a control/benchmark.

HEK293 cells were plated at 15,000 cells/well in six 96-well tissue culture plates. Cells were grown in 100 μL of DMEM+10% FBS+1× non-essential amino acids (NEAA) and incubated overnight at 37° C. The cells were transiently transfected with either 10 ng or 100 ng plasmid DNA/well of pGL4.29 9B8 opt, pGL4.29 9B8 opt-P, or pGL4.29. Plasmid DNA was mixed with 850 μL of OPTI-MEM® (Invitrogen) and 32.4 μL of FUGENE® HD transfection reagent (Promega Corp.) and incubated at room temperature for 10 min. Eight μL of the transfection/reporter DNA mixture was added to the appropriate wells (2 constructs/plate). Cells were incubated for 4 hrs at 37° C. The medium was replaced with OPTI-MEM®+0.5% dialyzed FBS+1× NEAA+1× sodium pyruvate+1× Penn-Strep and incubated overnight at 37° C.

Following incubation, 10 nM or 10 μM FSK (from a 10× stock) in OPTI-MEM® was added to the cells and incubated for 3 hrs at 37° C. A lytic reagent containing 100 mM MES pH 6.1, 1 mM CDTA, 150 mM KCl, 35 mM thiourea, 2 mM DTT, 0.25% TERGITOL® NP-9 (v/v), 0.025% MAZU® DF 204, and 20 μM PBI-3939 was added to the cells containing pGL4.29 9B8 opt or pGL4.29 9B8 opt-P and allowed to incubated for 10 min at room temperature (100 μL lytic reagent added to 100 μL cells). ONE-GLO™ assay reagent (Promega Corp.) was added to cells containing pGL4.29 and used according to the manufacturer's protocol (100 μL reagent added to 100 μL cells). Luminescence was measured on a GLOMAX® Luminometer. Table 26 shows the luminescence of the HEK293 cells expressing the transcriptional reporters containing CRE treated with 10 nM ("baseline") or 10 mM FSK, and the response to FSK (i.e., the luminescence generated by the 10 mM FSK treated cells divided by the luminescence generated of the 10 nM FSK treated cells).

The results shown in Table 28 indicate that 9B8 opt and 9B8 opt-P were brighter than luc2P, and that all the luciferase reporters responded to FSK when 100 ng of DNA was used for the transfection. However, when only 10 ng of DNA was used for the transfection, the luminescence for the luc2P reporter was below the detection level for the luminometer.

TABLE 28

Transcriptional Reporters Containing CRE in HEK293 Cells (3 h timepoint)

| Reporter construct | 100 ng DNA for transfection | | | 10 ng DNA for transfection | | |
|---|---|---|---|---|---|---|
| | baseline | RLU (10 mM FSK) | Response | baseline | RLU (10 mM FSK) | Response |
| 9B8 opt | 3,078,418 | 104,687,723 | 34 | 192810 | 12,926,465 | 67 |
| 9B8 opt-P | 122,071 | 20,544,753 | 168 | 11179 | 1,353,459 | 121 |
| luc2P | 356 | 5,293 | 15 | 0 | 0 | — |

Reverse Transfection

Transcriptional reporters containing the antioxidant response element (ARE) and 9B8 opt or 9B8 opt-P were prepared in the pGL4.29 (Promega Corp.) backbone, i.e., the luc2P gene of the pGL4.29 vector was replaced with 9B9 opt or 9B8 opt-P, and CRE was replaced with 2×ARE (SEQ ID NO: 66) using methods known in the arts.

HEK293 cells were trypsinized (T75 flask, 3 mL trypsin) and resuspended in $1 \times 10^5$ cells/mL (approximately $8.9 \times 10^6$ total cells) in medium containing DMEM+10% FBS+1× NEAA. Each transcriptional reporter was prepared for transfection by mixing 1.2 mL OPTI-MEM®, 12 µL transcription reporter DNA (100 ng) and 36 µL FUGENE® HD transfection reagent together and incubated at room temperature for 35 min. Following incubation, 624 µL of the transfection/reporter DNA mixture was added to 12 mL of cell suspension and mixed by inversion. After mixing, 100 µL of the cell/DNA mixture was added to wells of a 96-well plate (2 constructs/plate). The cells were incubated at 37° C. for 22 hrs. Tert-butylhydroquinone (a Nrf2 stabilizer; tBHQ; 1 µM ("baseline") or 20 µM) or sulphoraphane, (an organosulfer antioxidant known to activate Nrf2; 1 µM ("baseline") or 20 µM) in OPTI-MEM® was added to each well and incubated at 37° C. for 24 hrs. Cells were lysed with 100 µL lytic reagent as described above for the forward transfection. Luminescence was measured on a GLOMAX® Luminometer.

Table 29 shows the luminescence of the HEK293 cells expressing the transcriptional reporters containing ARE treated with 1 µM ("baseline") or 20 µM sulphoraphane and the response to sulphoraphane (i.e., the luminescence generated by the 1 µM sulphoraphane treated cells divided by the luminescence generated of the 20 µM sulphoraphane treated cells). Table 30 shows the luminescence of the HEK293 cells expressing the transcriptional reporters containing ARE treated with 1 µM ("baseline") or 20 µM tBHQ, and the response to tBHQ (i.e., the luminescence generated by the 1 µM tBHQ treated cells divided by the luminescence generated of the 20 µM tBHQ treated cells). Tables 29 and 30 show that 9B8 opt and 9B8 opt-P could report the presences of two different known stimuli for ARE.

TABLE 29

Transcriptional Reporters Containing ARE in HEK293 Cells (24 h time point)

| Reporter construct | 100 ng DNA for transfection | | |
|---|---|---|---|
| | baseline | RLU (20 mM sulphoraphane) | Response |
| 9B8 opt | 15,600,000 | 89,600,000 | 5.8 |
| 9B8 opt-P | 258,406 | 3,940,000 | 15 |

TABLE 30

Transcriptional Reporters Containing ARE in HEK293 Cells (24 h time point)

| Reporter construct | 100 ng DNA for transfection | | |
|---|---|---|---|
| | baseline | RLU (20 mM tBHQ) | Response |
| 9B8 opt | 15,100,000 | 120,000,000 | 8 |
| 9B8 opt-P | 317,238 | 8,460,000 | 27 |

Bulk Transfection

The transcriptional reporters containing CRE and 9B8 opt or 9B8 opt-P described in the forward transfection were used in the bulk transfection of HEK293 and NIH3T3 cells. Transcriptional reporters containing the heat shock response element (HRE; SEQ ID NO: 67) and 9B8 opt or 9B8 opt-P were prepared in the pGL4.29 (Promega Corp.) backbone, i.e., the luc2P gene of the pGL4.29 vector was replaced with 9B9 opt or 9B8 opt-P, and the CRE was replaced with HRE. The transcriptional reporter containing HRE and 9B8 opt-P was used in the bulk transfection of HeLa cells HEK293, NIH3T3, or HeLa cells were plated to a single well of a 6-well tissue culture plate the day before transfection at a density of $4.5 \times 10^5$ cells/well in 3 mL complete medium (DMEM+10% FBS+1×NEAA+1× sodium pyruvate) for HEK293 cells, $3 \times 10^5$ cells/well in 3 mL complete medium (DMEM+10% fetal calf serum (FCS)+1×NEAA+1× sodium pyruvate) for NIH3T3 cells, or $9.9 \times 10^5$ cells/well in 3 mL complete medium (DMEM+10% FBS+1×NEAA) for HeLa cells. Cells were grown overnight at 37° C.

3,300 ng of reporter plasmid DNA in 155 µL OPTI-MEM® was mixed with 9.9 µL FUGENE® HD transfection reagent, vortexed briefly, and incubated at room temperature for 10 min. The CRE transcriptional reporters were used to transfect HEK293 and NIH3T3 cells. The HRE transcriptional reporters were used to transfect HeLa cells. The reporter mixture was added to cells and mixed by gentle rocking followed by incubation at 37° C. for 6 hrs (HEK293 and NIH3T3) or 3 hrs (HeLa). Cells were then trypsinized and resuspended in medium (DMEM+10% FBS+1×NEAA+1× sodium pyruvate for HEK293 cells, DMEM+10% FCS+1×NEAA+1× sodium pyruvate for NIH3T3 cells, or DMEM+10% FBS+1×NEAA for HeLa cells), followed by plating to the individual wells of a 96-well plate (20,000 cells/100 µL for HEK293, 10,000 cells/100 µL for NIH3T3, or 13,000 cells/µL for HeLa) and incubated at 37° C. overnight.

FSK (CRE stimulator) or 17-AAG (HRE stimulator; 17-Allylamino-demethoxy geldanamycin) in OPTI-MEM® was added to the cells (10 nM or 10 µM final concentration for FSK; 1 nM or 1 µM final concentration for 17-AAG) and incubated at 37° C. for 4 hrs (FSK) or 6 hrs (17-AAG). Plates were removed from the incubator and allowed to equilibrate to room temperature for 25 min. Cells were lysed with 100 µL lytic reagent as described above for the forward transfection. Luminescence was measured on a GLOMAX® Luminometer.

Table 31 shows the luminescence of the HEK293 cells expressing the transcriptional reporters containing CRE treated with 10 nM ("baseline") or 10 mM FSK and the response to FSK. Table 32 shows the luminescence of the NIH3T3 cells expressing the transcriptional reporters containing CRE treated with 10 nM ("baseline") or 10 mM FSK and the response to FSK. Table 33 shows the luminescence of the HeLa cells expressing the transcriptional reporters containing HRE treated with 10 nM ("baseline") or 10 mM 17-AAG and the response to 17-AAG.

Tables 29-31 show that 1) both versions of the 9B8opt OgLuc variant can report the presence and stimulatory effects of FSK on CRE in the context of two different cell lines, HEK293 and NIH3T3, and 2) 9B8 optP can report the presence and stimulatory effects of 17-AAG on HRE in the context of HeLa cells.

TABLE 31

Transcriptional Reporters Containing CRE in HEK293 Cells (4 h time point)

100 ng DNA for transfection

| Reporter construct | baseline | RLU (10 mM FSK) | Response |
|---|---|---|---|
| 9B8 opt | 39,700,000 | 654,000,000 | 16 |
| 9B8 opt-P | 3,960,000 | 460,000,000 | 116 |

TABLE 32

Transcriptional Reporters Containing CRE in NIH3T3 Cells (4 h time point)

100 ng DNA for transfection

| Reporter construct | baseline | RLU (10 mM FSK) | Response |
|---|---|---|---|
| 9B8 opt | 9,187,000 | 23,600,000 | 2.6 |
| 9B8 opt-P | 410,461 | 3,720,000 | 9 |

TABLE 33

Transcriptional Reporters Containing HRE in HeLa Cells (6 h time point)

100 ng DNA for transfection

| Reporter construct | baseline | RLU (1 mM 17-AAG) | Response |
|---|---|---|---|
| 9B8 opt-P | 278,118 | 3,204,000 | 12 |

Example 38—Lytic and Secretable Reporter in Difficult to Express Cells

HepG2 cells, $1\times10^5$ cells/mL in a cell suspension, were reverse transfected with plasmid DNA (pGL4.32 backbone; Promega Corp.) containing L27V02, luc2P (Promega Corp.), luc2 (Promega Corp.) or L27V02-IL6 (L27V02 with the native secretion sequence replaced with the IL-6 secretion sequence; ("IL601-L27V02A"; SEQ ID NO: 324) using FUGENE® HD according to the manufacturer's instructions (1:20 DNA-transfection mixture to cells). 100 µL cell suspension was then plated into wells of a 96-well plate and incubated for 22 hrs at 37° C., 5% $CO_2$. Other OgLuc constructs which have the native secretion sequence replaced by the IL-6 secretion sequence include IL601-L27V01 and IL602-L27V03 (SEQ ID NOs: 321 and 327, respectively).

Figure 62:
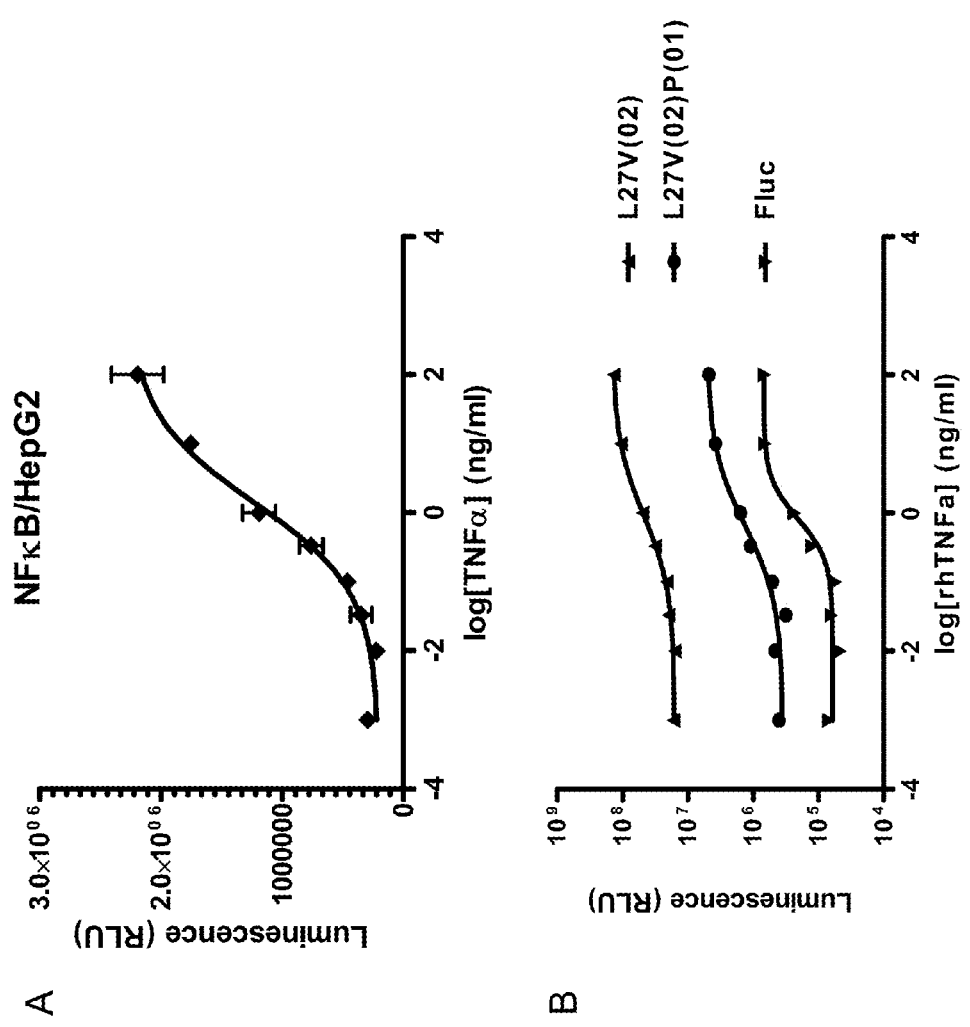
FIGS. 62A-B show the luminescence of secreted OgLuc variant L27V02 (containing the IL-6 secretion signal) reporter (FIG. 62A) and L27V02 ("L27V (02)"), L27V02P ("L27V(02)P(01)") and Luc2 ("Fluc") reporters (FIG. 62A) expressed in HepG2 cells treated with various doses of rhTNFα ("TNFα").

For secretion analysis, the media was removed from the cells, and the cells washed in 100 µL DPBS. 100 µL complete media (DMEM+10% FBS+1×NEAA) was added along with varying doses (1 pg/mL-100 ng/mL) of rhTNFα ("TNFα") for 4.5 h. 10 µL of the media was then removed, added to 90 µL complete media, and 100 µL assay reagent (as previously described; 100 µM PBI-3939) added. Luminescence was measured as previously described (FIG. 62A).

For lytic analysis, following plating, the cells were incubated for 4.5 hrs at 37° C., 5% $CO_2$. The cells were then allowed to equilibrate to room temperature for 20 min. Assay reagent (as previously described; 100 µM PBI-3939) was added to the cells, and luminescence measured as previously described (FIG. 62B).

Example 39—Additional Lytic Reporter Features

The OgLuc variants of the present invention in the context of a cell-based, lytic transcriptional reporter should offer a luminescent signal of a magnitude such that the signal appears sooner than it might with other luciferases. The bright luminescence should also allow for weak promoters to be examined Example 40—Mammalian Cell Transfections The OgLuc variants of the present invention were used as reporters in difficult to transfect cell lines, e.g., Jurkat, HepG2, primary cells, non-dividing primary cells, or stem cells. (See e.g., FIG. 59C) Due to their high signal intensity, the OgLuc variants enable detectable luminescence when transfection efficiency is low. The OgLuc variants can also be used as reporters in cells that are especially sensitive to conditions associated with transfection, i.e., DNA concentration, transfection reagent addition. Due to the brightness of the OgLuc variants, an adequate level of luminescence can be achieved using lower DNA concentrations, less transfection reagent, and perhaps shorter post-transfection times prior to beginning an assay. This will place less of a toxicity burden on what would otherwise be sensitive cells. The bright luminescence of the OgLuc variants should also allow for a signal to be detected at very long time points in the event such an output is desirable. As another example, the OgLuc variants could be used as reporters for single copy native promoters, e.g., HSB thymidylate kinase (TK) promoter, HOX genes, or LIN28.

Example 41—Stable Cell Lines

The identification of robust, stable cell lines expressing an OgLuc variant of the present invention, either in the cytoplasm or as a secreted form, can be facilitated by the bright signal of the luciferase and the small size of the OgLuc gene. The relatively small gene sequence should reduce the likelihood of genetic instability resulting from the integration of the foreign DNA.

To generate stable cell lines using an OgLuc variant of the present invention, plasmid DNA comprising a nucleotide sequence for an OgLuc variant and a selectable marker gene, e.g., neomycin, hygromycin, or puromycin, is used to transfect a cell line of interest, e.g., HEK293 cells. Cells of an early passage number, e.g., less than 10 passages, are plated into T25 ($1\times10^6$) or T75 ($3\times10^6$) tissue culture flasks and allowed to grow overnight to approximately 75% confluency. Cells are then transfected using the above plasmid DNA and an appropriate transfection reagent, e.g., TRANSIT®-LT1 or FUGENE® HD. Forty-eight hrs post-transfection, the media is replaced on the cells with selection media containing the selection drug, e.g., G418, hygromycin or puromycin, at a concentration previously determined to kill untransfected cells. Selection of cells containing the plasmid DNA occurs over 2-4 weeks. During this time, the cells are re-plated in selection media at various concentrations into either T25 or T75 tissue culture flasks. The media on the re-plated cells is replaced every 3-4 days for 2-3 weeks with fresh selection media. The flasks are monitored for the formation of live cell colonies. Eventually, the flasks will contain many large colonies and few dead cells.

From the pool of stable colonies in the flasks, single colonies are isolated and expanded into a single 24-well tissue culture plate. Briefly, cells are harvested using the trypsin/EDTA method, i.e., cells are harvested by removing media, rinsing with $Ca^{2+}$ and $Mg^{2+}$ free PBS and detached by treatment with Trypsin/EDTA. The cells are counted using a hemocytometer and diluted $1\times10^5$ in complete media. The cells are then diluted to 100 cells/mL, 33 cells/mL, 10 cells/mL, and 3.3 cells/mL in complete media. 100 µL of each dilution is plated into all wells of 96-well tissue culture plate (1 plate for each dilution) and allowed to grow 4-5 days after which 50 µL of selection media is added to the cells. Approximately a week after plating, cells are visually screened for colony growth and another 50 µL of selection media is added. The cells continue to be monitored until a single colony covers 40-60% of the well area. When a colony is ready for expansion and screening, colonies are harvested using the trypsin/EDTA method. Each colony is transferred to selection media as follows: 1) Dilute 1:10 into 6 wells of a 96-well assay plate for functional assay, e.g., luminescence detection; 2) Dilute 1:10 into 3 wells of a clear bottom 96-well assay plate for cell viability assay, e.g., CELLTITER-GLO® Luminescent Cell Viability Assay (Promega Corp.); and 3) Dilute 1:10 into a 24-well tissue culture plate for expansion. Cells in the plates for the functional and cell viability assay are then grown 2-3 days and the functional and cell viability assays performed. Positive clones in the 24-well plate are further tested with the functional and cell viability assays as well as for stability of expression and response for at least 20 passages, normal growth rate morphology, and frozen for future use at the earliest possible passage.

Example 42—OgLuc Secretion Signal Analysis

A. IV Opt

Figure 63:
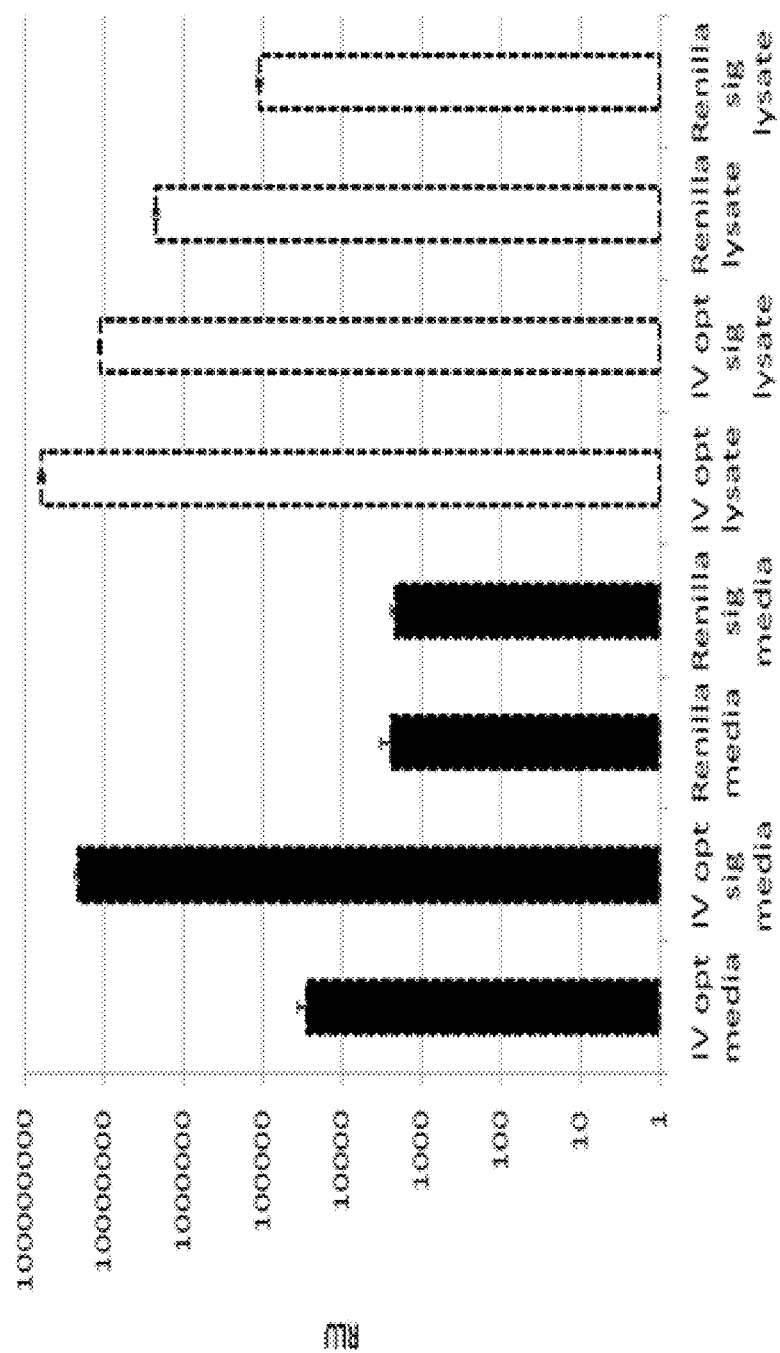
FIG. 63 shows the luminescence generated from media and lysate samples of HEK293 cells expressing the codon optimized variant IV opt with or without the secretion signal sequence using the novel PBI-3939 as a substrate compared to hRL ("Renilla") with or without the secretion signal sequence using native coelenterazine as a substrate.
Figure 64:
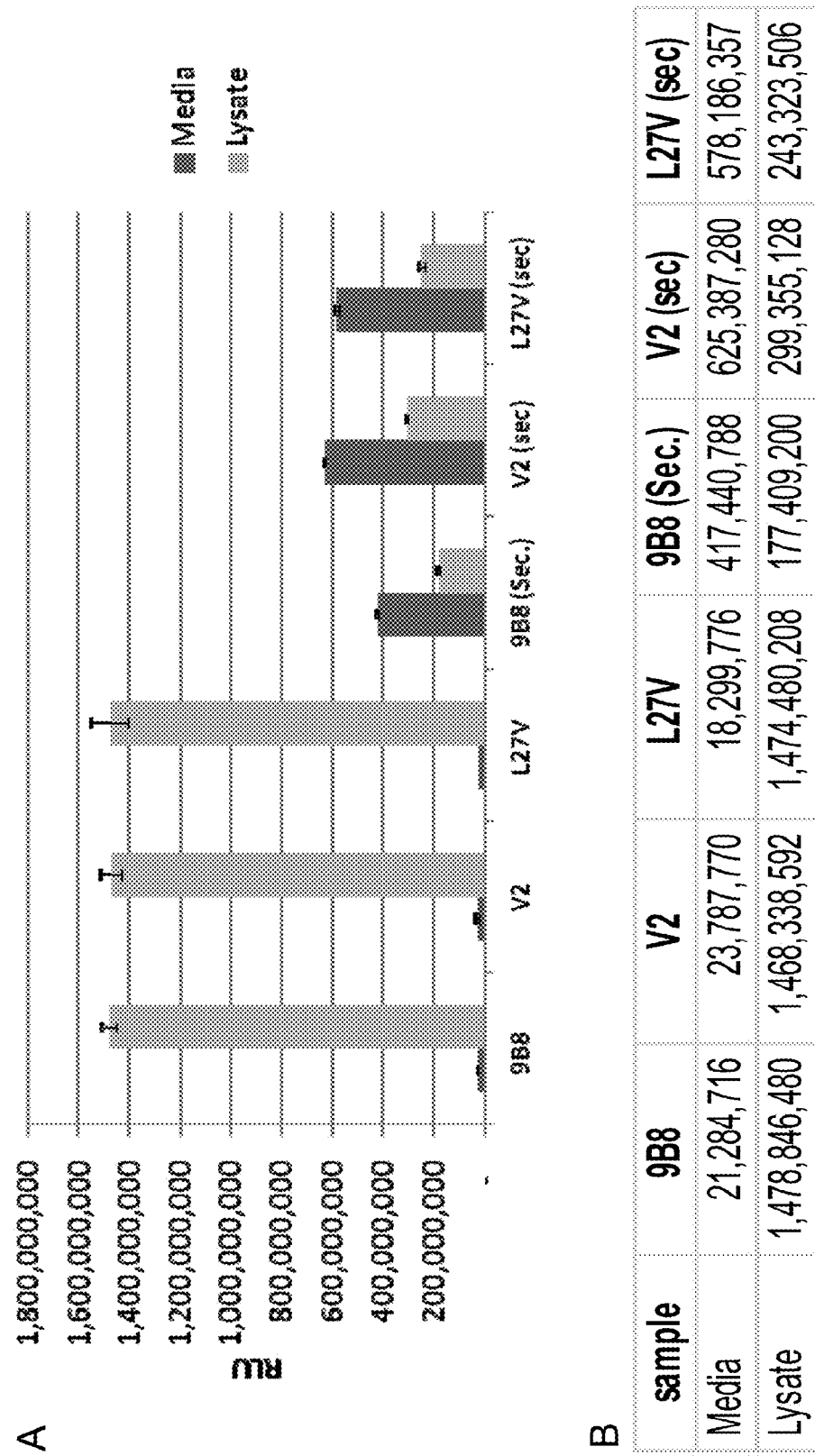
FIGS. 64A-D show the luminescence of the secreted OgLuc variants 9B8, V2 and L27V reporters expressed in CHO cells (FIGS. 64A and 64B) and HeLa (FIGS. 64C and 64D).
Figure 64:
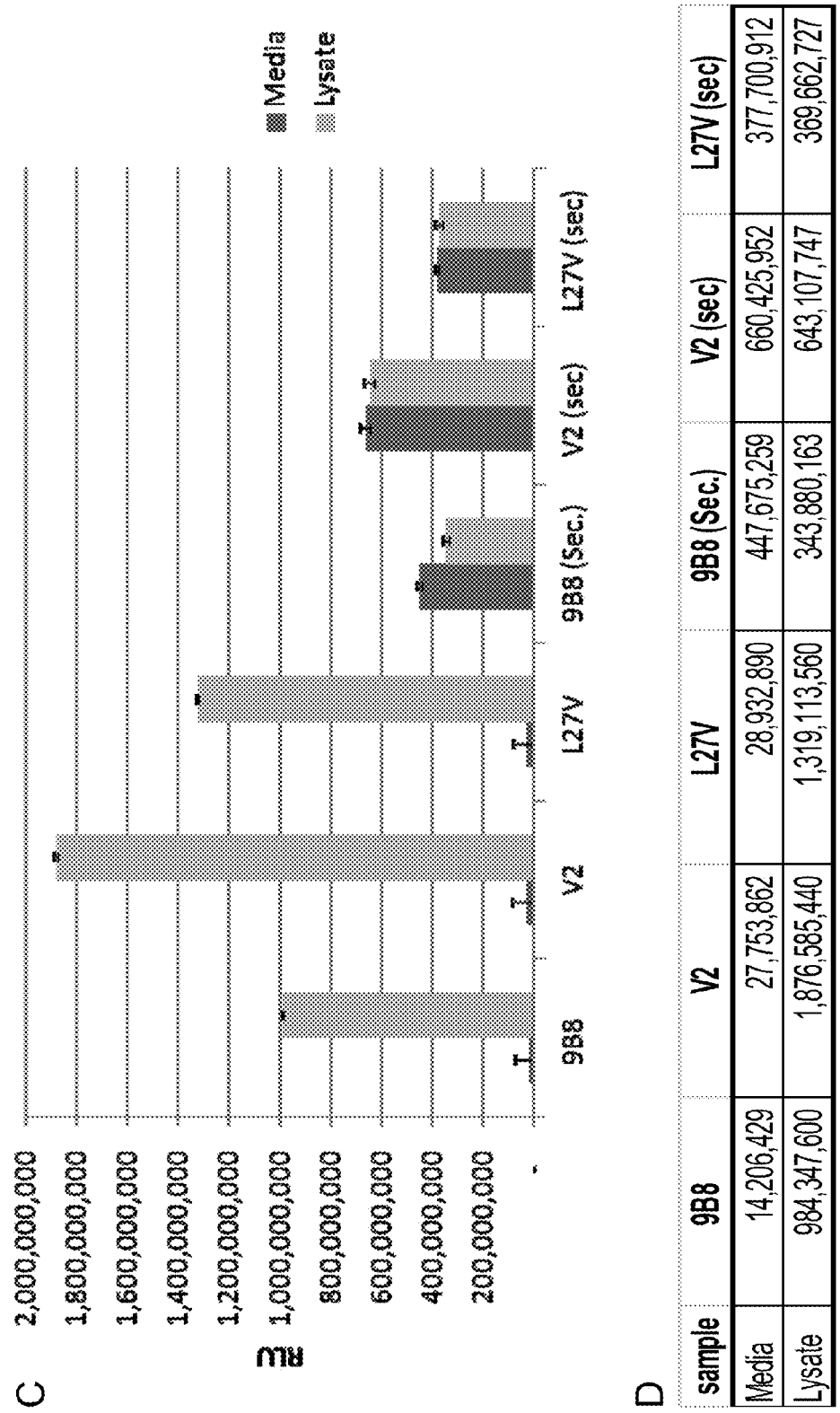

The wild-type OgLuc is processed after synthesis into a mature protein with the secretion signal sequence cleaved off. To determine if the secretion signal sequence would facilitate secretion of the OgLuc variant, the IV opt variant of Example 25 and hRL were cloned into pF4Ag containing an N-terminal OgLuc secretion signal (SEQ ID NO: 54). HEK293 cells (15,000) in 100 µL Dulbecco's Modified Eagle's medium ("DMEM") with 10% fetal bovine serum (FBS) were transfected as described in Example 25 with 100 ng of plasmid DNA, i.e., hRL or IV opt with or without the secretion signal and grown overnight at 37° C. 50 µL of media was removed to a new plate and saved for a later assay generating a "media" sample. The rest of the media was removed, and the cells were lysed with 100 µL of lysis buffer described in Example 25 to generate a "lysate" sample. 10 µL of media sample and 10 µL of lysate sample were assayed for luminescence (FIG. 63). Samples for hRL with ("*Renilla* sig") or without ("*Renilla*") the OgLuc secretion signal sequence were measured using 50 µL of lysis buffer containing 20 µM native coelenterazine. Samples for IV opt with ("IV opt sig") or without ("IV opt") the OgLuc secretion signal sequence were measured using 50 µL of lysis buffer containing 20 µM PBI-3939.

In FIG. 63, the filled bars represent the amount of light that was detected from the media in the absence of any lytic reagent. The open bars represent the total light (secreted+ non-secreted) that was detected upon addition of a lytic reagent. FIG. 63 shows that IV opt was secreted from HEK293 cells into the growth media and that the secretion signal sequence was functional in mammalian cells. "IV opt sig" represents the only situation where a significant amount of luciferase was detected in the media. The results also indicate that this particular signal peptide did not facilitate secretion of hRL.

B. 9B8, V2 and L27V

To determine if the secretion signal sequence of OgLuc facilitates its secretion, the OgLuc variants 9B8, V2 and L27V were cloned into pF4Ag containing an N-terminal OgLuc secretion signal sequence. The variants were also cloned into vectors without the secretion signal sequence. CHO or HeLa cells were then plates at 100,000 cells/well in 1 mL F12 media with 10% FBS and 1× sodium pyruvate (CHO cells) or DMEM with 10% FBS and 1× sodium pyruvate (HeLa cells) into 12-well plates and incubated overnight at 37° C., 5% $CO_2$.

After the overnight incubation, the cells were transfected with 1 µg plasmid DNA containing 9B8, V2, or L27V with or without the secretion signal sequence using the TRANSIT®-LT1 transfection reagent (Mirus Bio) and OPTI-MEM® media (Invitrogen). The cells were again incubated overnight at 37° C., 5% $CO_2$.

After the second overnight incubation, the media was removed and saved for analysis. To the cells, 1 mL of assay buffer (1 mM CDTA, 150 mM KCl, 2 mM DTT, 100 mM MES pH 6.0, 35 mM Thiourea and 0.5% TERGITOL® NP-9 (v/v)) was added to create a cell lysate. To 10 µL of cell lysate or saved media from each sample, 50 µL assay buffer with 40 µM PBI-3939 was added, and luminescence measured as described above. FIGS. 64A-D demonstrates that 9B8, V2 and L27V variants can be used in a secretable system.

To determine the stability of the secreted variants, 150 µL aliquots of the saved media from each sample was placed at 37° C. or 50° C. The aliquots were then removed at different time points (0, 1, 2, 3, 5, 6, and 7 min), frozen on dry ice, and kept at −20° C. until assayed. To assay for stability, the media aliquots were thawed to room temperature, and 10 µL of each aliquot was mixed with assay buffer with PBI-3939 (pH 6.0) as described above. Luminescence was measured as above, and the half-life ($t_{50}$) determined (Table 34).

TABLE 34

| sample | ½ life 37 C. (days) |
|---|---|
| 9B8 | 8 |
| V2 | 10 |
| L27V | 17 |
| | ½ life 50 C. (hours) |
| 9B8 | 3 |
| V2 | 7 |
| L27V | 11 |

C. 9B8 and V2 Comparison to Secreted Luciferase of *Metridia longa*

The secretion of the OgLuc variants 9B8 and V2 was compared to that of the secreted luciferase from *Metridia*

Figure 65:
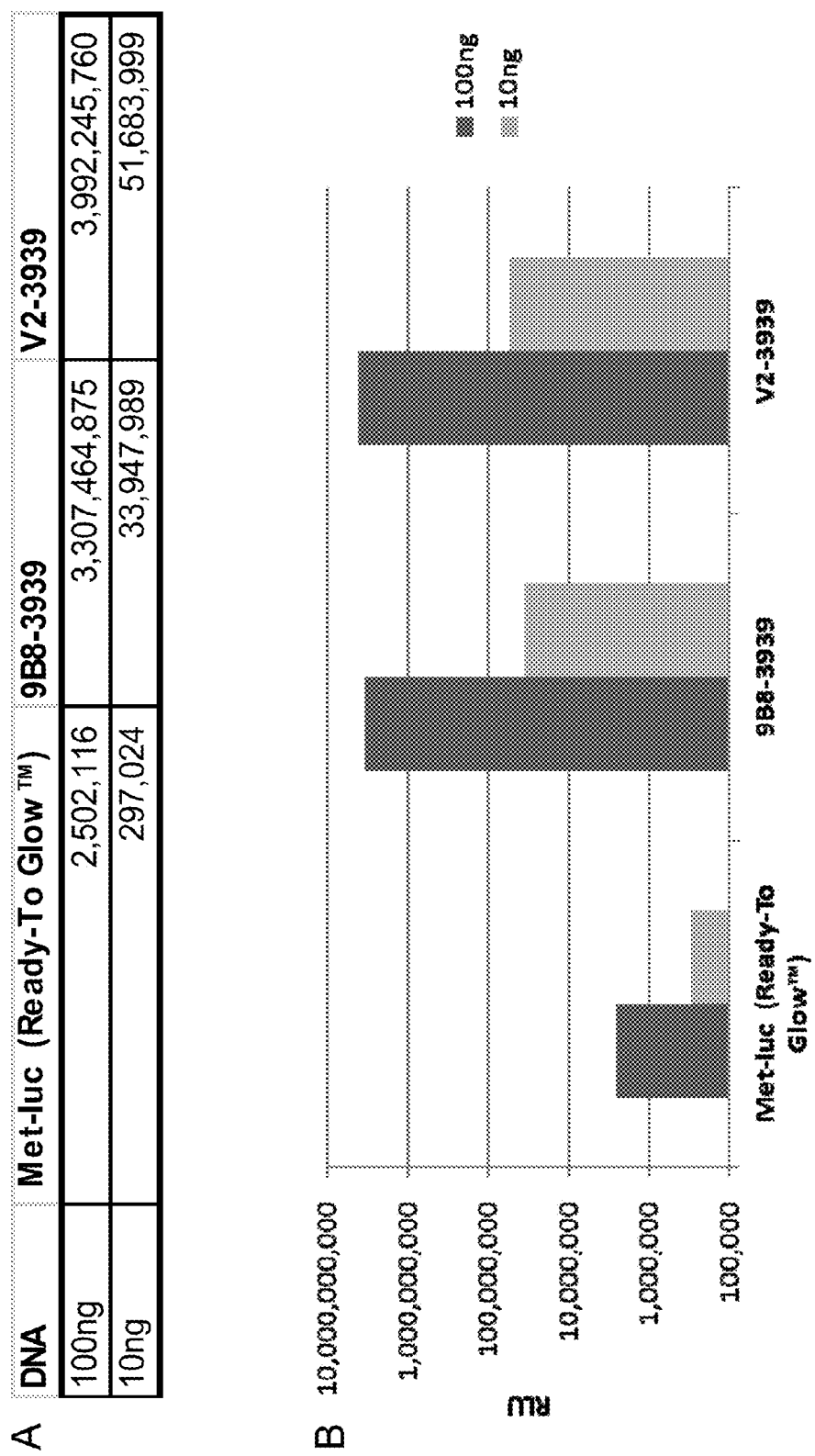
FIGS. 65A-B show a comparison of the luminescence from the secreted OgLuc variants 9B8 and V2 using PBI-3939 as a substrate to that of the secreted luciferase of *Metridia longa* using Ready-to-Glow™ as a substrate numerically (FIG. 65A) and graphically (FIG. 65B).

*longa*. CHO cells were plated at 300,000 cells/well in 3 mL F12 media with 10% FBS into wells of 6-well plates and incubated overnight at 37° C., 5% $CO_2$. The cells were then transfected with either 10 or 100 ng of each variant or *Metridia* luciferase (Clontech) plasmid DNA using TRANSIT®-LTI according to the manufacturer's instructions and incubated for 20 hrs at 37° C., 5% $CO_2$. After transfection, the media was removed from the cells and assayed. For the OgLuc variants, 50 μL of media was assayed with 50 μL of assay reagent (previously described; 40 μM PBI-3939). For *Metridia* luciferase, the media was assayed using the Ready-to-Glo™ Secreted Luciferase Reporter System (Clontech) according to the manufacture's protocol. Briefly, 5 μL of the 1× substrate/reaction buffer was added to 50 μL of media sample. Luminescence was then measured as previously described (FIGS. 65A-B).

Example 43—Evaluation of OgLuc Variants and Novel Coelenterazine in Live Cells

Figure 66:
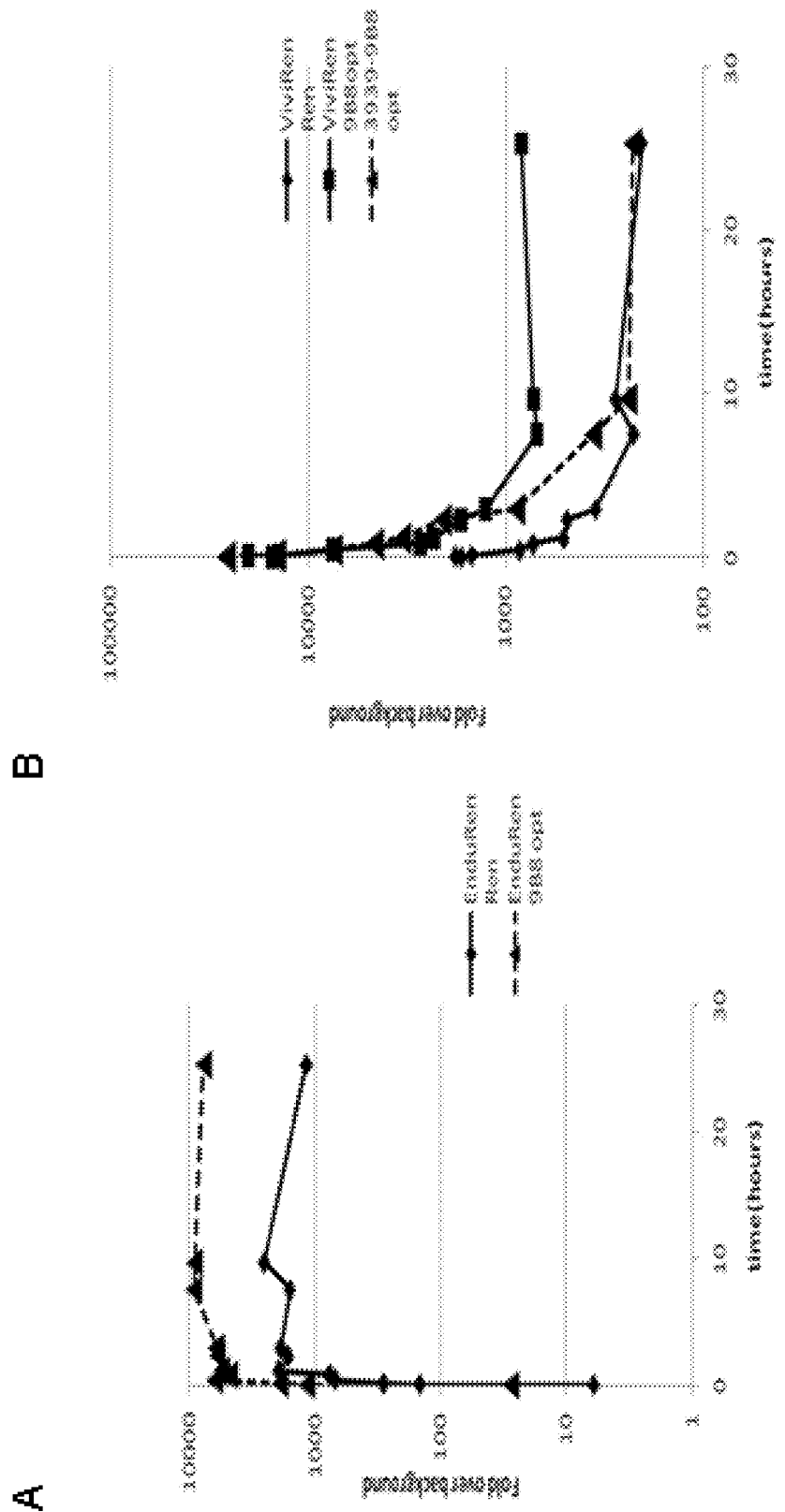
FIGS. 66A-B show the fold-increase in luminescence over background generated from HEK293 cells expressing hRL ("Ren") and 9B8 opt using the coelenterazine derivatives ENDUREN™ (FIG. 66A) and VIVIREN™ (FIG. 66B) and the novel coelenterazine PBI-3939 (FIG. 66B) as substrates.

A. The use of OgLuc variants and PBI-3939 in live cells was examined HEK293 cells were plated in 96-well plates at 15,000 cells/well and grown overnight at 37° C. The following day, the cells were transiently transfected using TRANSIT®-LT1 in 3 replicates with 100 ng of hRL or 9B8 opt in pF4Ag and grown overnight at 37° C. The following day the growth media was removed and replaced with media containing 60 μM VIVIREN™ Live Cell Substrate (Promega Corp.), 60 μM ENDUREN™ Live Cell Substrate (Promega Corp.), or 60 μM PBI-3939 for both hRL and 9B8 opt transfected cells. Non-transfected cells were used as background control. The plate was incubated at 37° C. during the course of one day and periodically measured on a TECAN® GENIOS™ Pro luminometer, i.e., 11 times over the course of 24 hrs. FIGS. 66A-B shows the luminescence of the transfected cells divided by the luminescence of the non-transfected cells for each of the substrates, i.e., the signal to background ratio. The data shows that 9B8 opt generated luminescence in a live cell setting (i.e., no lysis) by incubating cells with VIVIREN™, ENDUREN™, or PBI-3939. The data also demonstrated that PBI-3939 can permeate cells in culture, react with the OgLuc variant, and generate luminescence, thus making it compatible with use in a live cell assay.

B. To demonstrate live cell analysis using the OgLuc variants, L27V was fused to HALOTAG® and expressed and monitored in live cells. U2OS cells were plated at 40,000 cells/mL into imaging chamber wells and incubated overnight at 37° C., 5% $CO_2$. Cells were than transfected using FUGENE® HD according to the manufacturer's protocol with the plasmids pFC14K, pFN21K or pF4Ag (all Promega Corp.) containing L27V or pF4Ag containing L27V with the native or IL-6 secretion sequence. Cells were then incubated for 24 hrs at 37° C., 5% $CO_2$.

Figure 67:
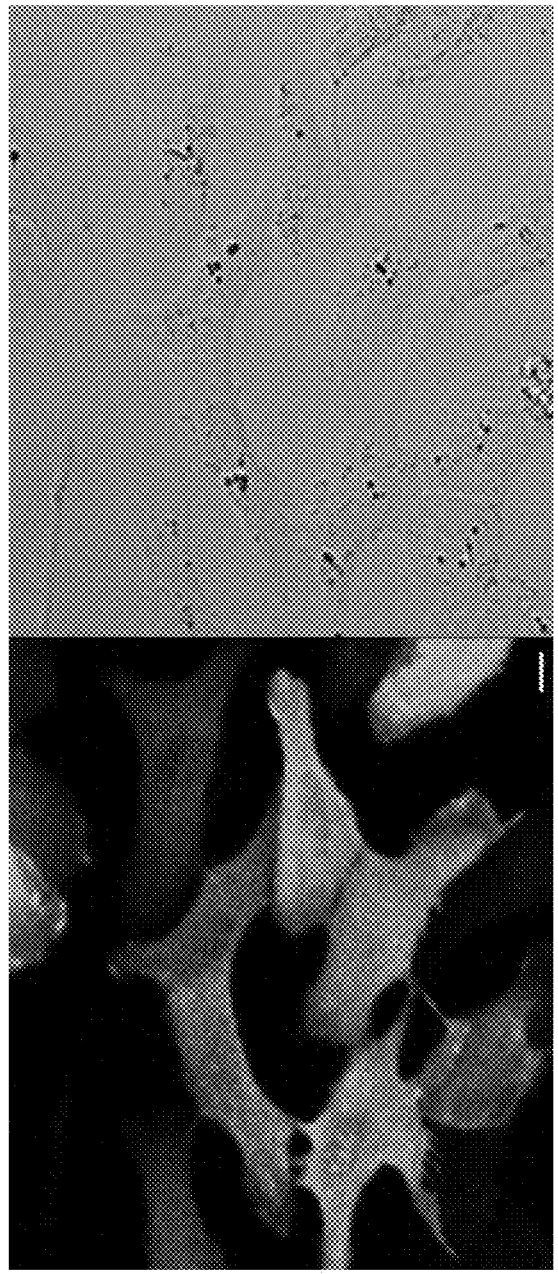
FIGS. 67A-D show confocal images of U2OS cells transiently expressing L27V-HaloTag® fusion (FIG. 67A) or IL6-L27V fusion (FIGS. 67B-D). Scale bars=20 μm.
Figure 67:
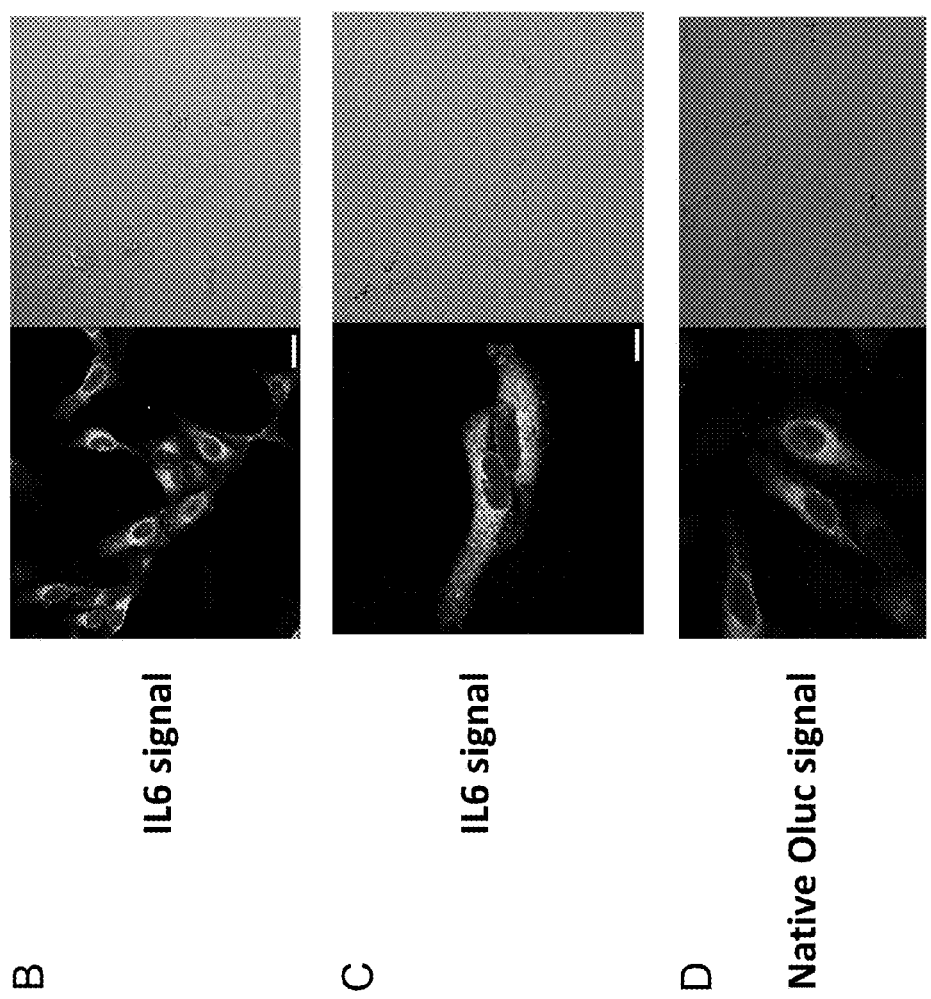

Following incubation, the cells were exposed to HALOTAG® TMR ligand (Promega Corp.), imaged, and fixed. Immunocytochemistry (ICC) was then performed according to the ICC protocol in the HALOTAG® Technology: Focus on Imaging technical manual (Promega Corp.; TM260). The primary antibody used was a polyclonal rabbit, anti-OgLuc 9B8 antibody (1:1000). The secondary antibody used was an Alexa 488 conjugated secondary antibody (green) (FIG. 67A). FIG. 67A shows green fluorescent channel and FIG. 67B shows the differential interference contrast (DIC). Images were acquired using an Olympus Fluoview FV500 confocal microscope (Olympus, USA) outfitted with a 37° C.+CO2 environmental chamber (Solent Scientific Ltd., UK).

FIGS. 67B-D shows the ICC images with native or IL-6 secretion sequence. Both signal sequences dramatically decrease the amount of enzyme in the nucleus. The punctuate nature of the labeling in the cytoplasm is indicative of vesicle formation expected to occur during the secretion process. The data demonstrates that the presence of a signal peptide reduces the amount of luciferase in the nucleus.

C. As shown above, the OgLuc variants and novel substrates of the present invention are biocompatible. A reporter system is envisioned where the OgLuc variant is cloned into an expression vector with a promoter of interest and expressed in cells as a reporter protein. The cells are then treated with PBI-3939 which will permeate cells in culture, react with the OgLuc variant, and generate luminescence.

In addition to being cell permeant, PBI-3939 shows comparable biocompatibility to native coelenterazine in terms of cell viability. A version of compound 3939 containing chemical modifications known to increase the stability of native coelenterazine in media can be synthesized and used for more robust, live cell OgLuc variant-based reporter assays. Another example of live cell reporting includes the use of a secretable OgLuc variant as a reporter. The native secretion signal peptide (or other known secretion signal peptides) can be fused to the N-terminus of an OgLuc variant so that when the fusion is expressed in mammalian cells, a portion of it will be secreted through the cell membrane into the culture media. Upon addition of substrate luminescence is generated.

Example 44—Protein Fusion Reporters

The OgLuc variants of the present invention can be used as fusion tags for a target protein of interest as a way to monitor intracellular levels of that target protein. Specific proteins involved in stress response pathways, e.g., DNA damage, oxidative stress, inflammation, can be monitored in cells as a way to probe the role various types of stimuli may play in these pathways. The variants can also be used as a means to monitor cellular trafficking of a target protein. The variants can also be fused to viral genomes (e.g., HIV, HCV) so that titer levels, i.e., infectivity, can be monitored in cells following treatment with potential antiviral agents. The variants can also be fused to green fluorescent protein (GFP) or HALOTAG® (in addition to a target protein) so that FACS could be used to identify high expression clones and to provide localization information.

Example 45—Evaluation of OgLuc Variant in 3-Component Fusion Protein ("Sandwich")

3-component fusion proteins, or "sandwich" fusions, can be used to place bioluminescent and fluorescent proteins close to one another for optimization of a biosensor based on BRET.

A. C1+4AE, IV, 9B8 and 9F6

The OgLuc variants C1+4AE (SEQ ID NOs: 55 and 56), IV (SEQ ID NOs: 57 and 58), 9B8 (SEQ ID NOs: 61 and 62), and 9F6 (SEQ ID NOs: 63 and 64), and hRL (SEQ ID NOs: 32 and 33) were cloned into a pF4Ag fusion vector with an N-terminal Id (Benezra et al., *Cell*, 61(1):49-59 (1990)), known to be a poor fusion partner, and a C-terminal HT7, which was used for normalization. The gene of interest was "sandwiched" between Id and HT7, i.e., Id-Luciferase-HT7. *E. coli* lysates, containing the variant constructs in pF4Ag or pF4Ag sandwich background, were prepared as described in Example 26 and then assayed with 20 µM native coelenterazine in the buffer described in Example 25.

Figure 68:
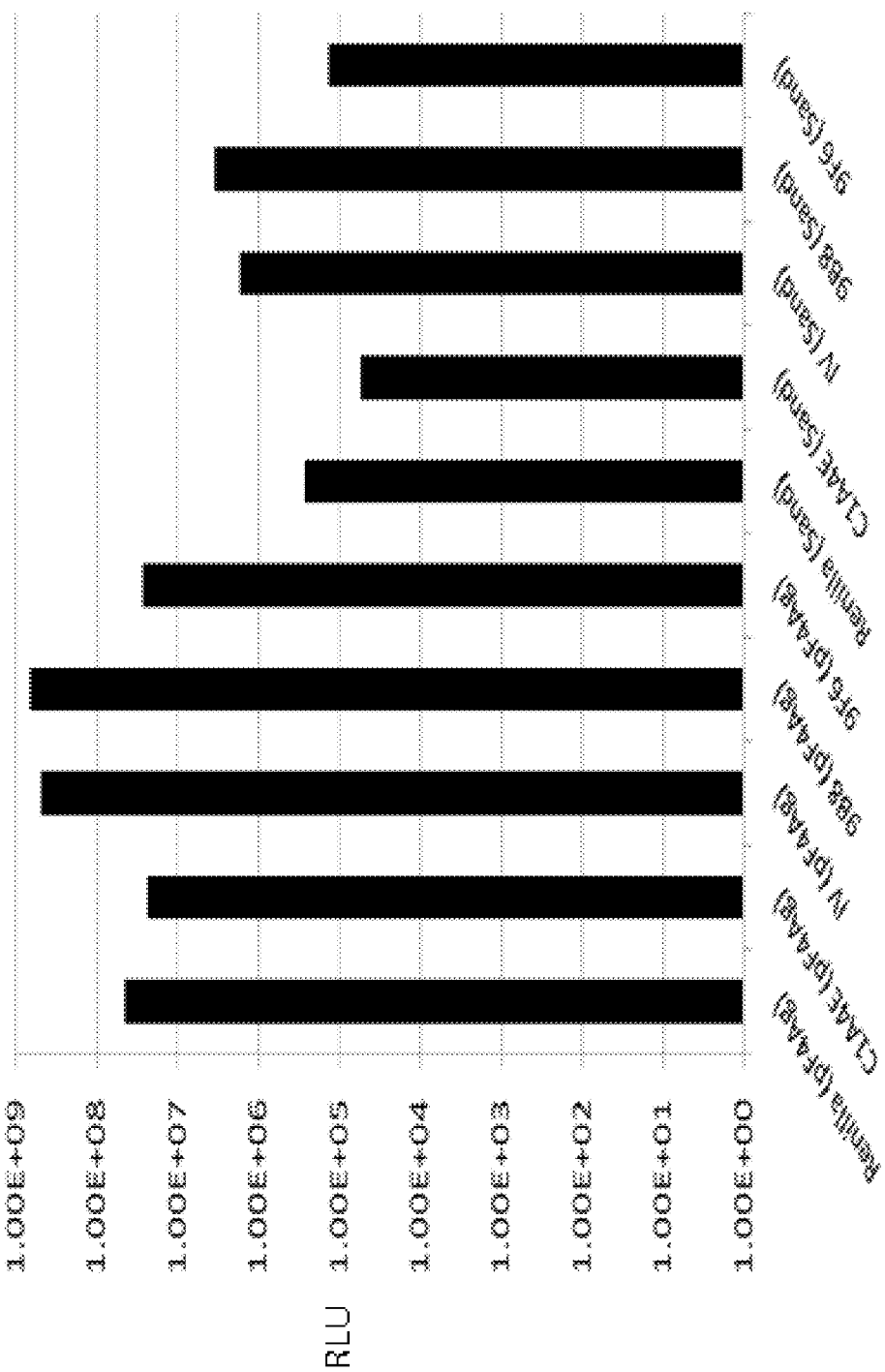
FIG. 68 shows the luminescence generated from lysed bacterial cells expressing various OgLuc variants and hRL ("*Renilla*") in the presence ("Sand") or absence of sandwich background ("pF4Ag") using native coelenterazine as a substrate.
Figure 69:
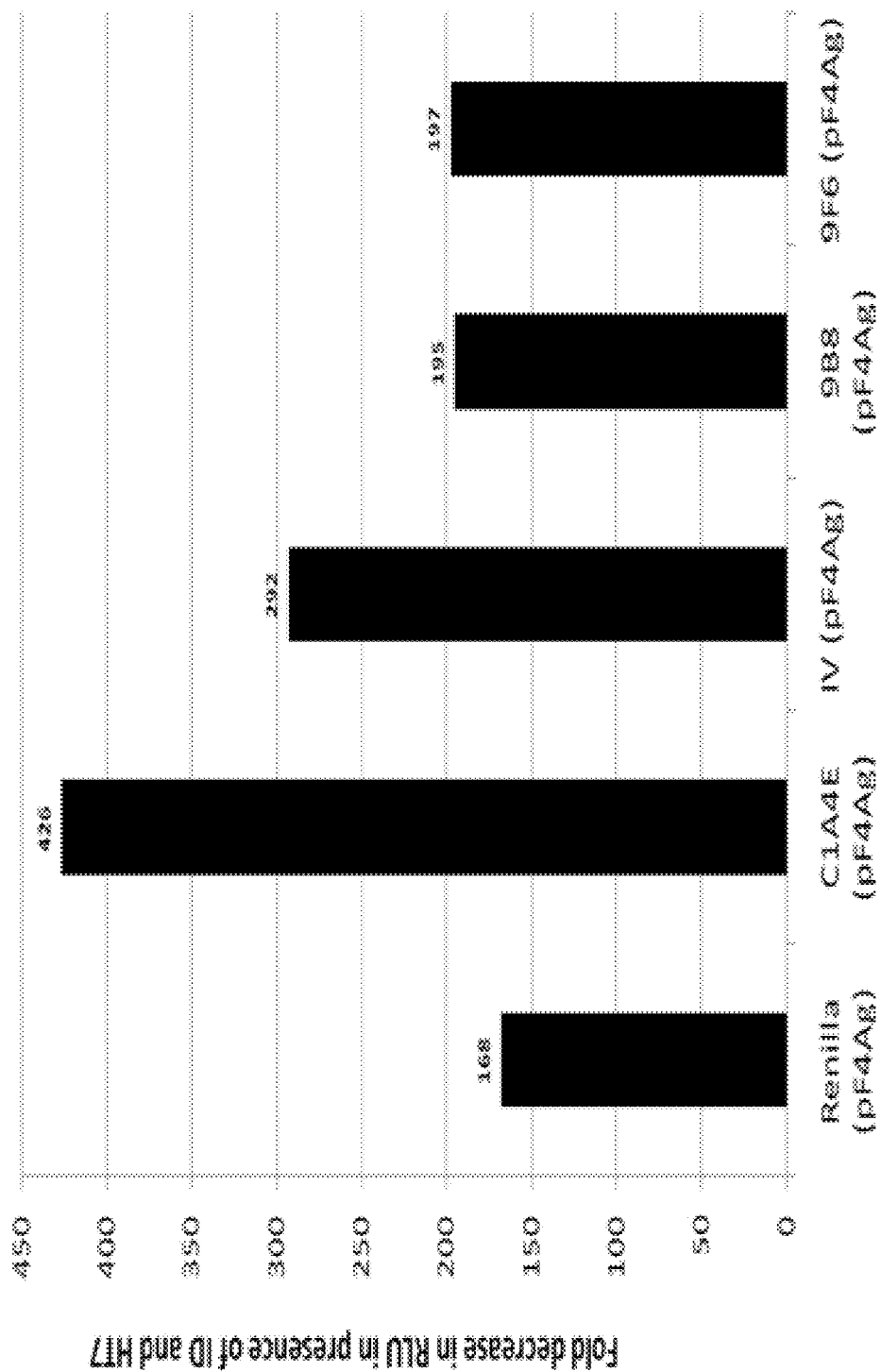
FIG. 69 shows the fold-decrease in activity of various OgLuc variants and hRL ("*Renilla*") due to the presence of the sandwich background using native coelenterazine as a substrate.

FIG. 68 shows the luminescence for each variant in either pF4Ag or pF4Ag sandwich background ("Sand"). FIG. 69 shows the fold-decrease in luminescence due to the presence of Id and HT7 and determined by dividing the luminescence of the variant in pF4Ag by the luminescence of the variant in the pF4Ag-sandwich. Samples with the largest values showed the most sensitivity to the poor fusion partner Id. The variant 9B8 was the brightest in the sandwich context.

B. 9B8 Opt and 9B8 Opt+K33N

Figure 70:
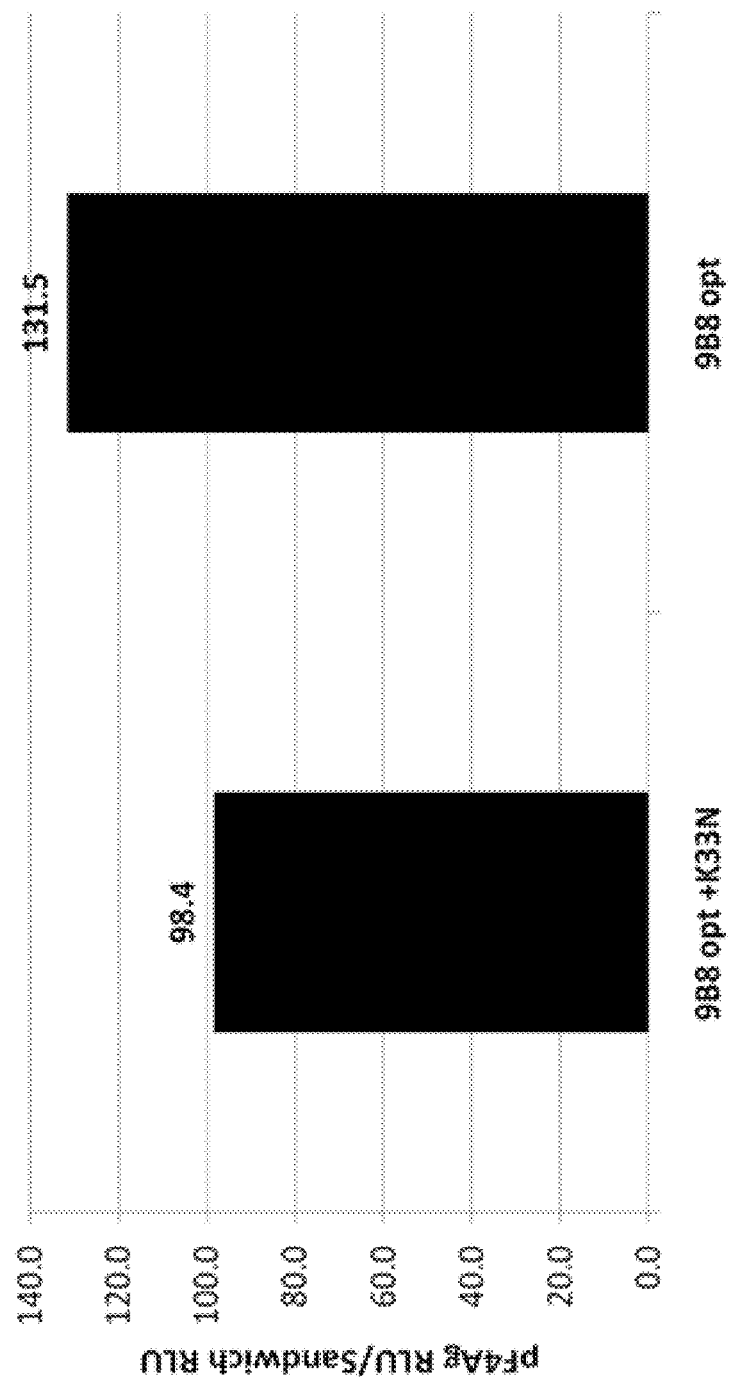
FIG. 70 shows the fold-decrease in activity of 9B8 opt and 9B8 opt+K33N in bacterial lysates due to the presence of the sandwich background using the novel coelenterazine PBI-3939 as a substrate.

The variants 9B8 opt and 9B8 opt+K33N were analyzed in a sandwich background as described above. Sandwich constructs for 9B8 opt (SEQ ID NOs: 40 and 41) and 9B8 opt+K33N (SEQ ID NOs: 59 and 60) were generated as described above. E. coli lysates were assayed and measured using the same assay buffer and luminometer as used for generating FIG. 40. FIG. 70 shows the fold-decrease in the presence of a sandwich background indicating that 9B8 opt+K33N is less sensitive to the poor fusion partner Id than 9B8 opt.

C. 23D2 and 24C2

Variants 23D4 (NF) and 24C2 (NF) were subcloned into the Id-OgLuc-HT7 sandwich background and assayed in E. coli. The sandwich variants, 23D4 (F) (SEQ ID NOs: 76 and 77) and 24C2 (F) (SEQ ID NOs: 78 and 79) were compared to 9B8 opt+K33N in the sandwich background (SEQ ID NO: 59 and 60). Table 35 shows the variants had at least the same luminescence as 9B8 opt+K33N in the sandwich background context.

TABLE 35

Increase in Luminescence Generated by OgLuc Variants Compared to 9B8 opt + K33N + 170G in Sandwich Background

| Sample | Sequence | Fold over 9B8 opt + K33N sandwich (E. coli) |
|---|---|---|
| 23D4 (F) | G26G, M106L, R112R, 170G | 1.0 |
| 24C2 (F) | R11Q, T39T, 170G | 1.0 |

D. 1F7 and 15H1

The PCR library in the Id-OgLuc-HT7 sandwich background was screened for additional variants with increased luminescence compared to 9B8 opt+K33N in sandwich background. Selected variants were then assayed in HEK293 and NIH3T3 cells. Table 36 shows the fold-increase in luminescence of the sandwich variants in E. coli, HEK293 and NIH3T3 cells, and the amino acid substitutions found in the variants. 1F7 (F) (SEQ ID NOs: 84 and 85) and 15H1 (F) (SEQ ID NOs: 86 and 87) had at least 1.3 fold-increase in luminescence in E. coli. 1F7 (F) was brighter than 9B8 opt+K33N in the sandwich background in HEK293 and NIH3T3 cells.

TABLE 36

Increase in Luminescence Generated by OgLuc Variants Compared to 9B8 opt + K33N in Sandwich Background

| Sample | Sequence | Fold over 9B8 opt + K33N sandwich | | |
|---|---|---|---|---|
| | | E. coli | HEK293 | NIH3T3 |
| 1F7 (F) | K43R, Y68D | 1.9 | 2.4 | 1.4 |
| 15H1 (F) | D19D, S66N | 1.5 | 0.9 | 1.2 |

The sandwich variants were subcloned into the pF4Ag-based non-fusion background vector to generate 1F7 (NF) (SEQ ID NOs: 80 and 81) and 15H1 (NF) (SEQ ID NOs: 82 and 83) and were analyzed as described above and compared to 9B8 opt+K33N. Table 37 shows the fold-increase in luminescence of the variants in E. coli, HEK293 and NIH3T3 cells. 1F7 (NF) and 15H1 (F) had at least 1.3 fold-increase in luminescence in E. coli and HEK293 cells.

TABLE 37

Increase in Luminescence Generated by OgLuc Variants Compared to 9B8 opt + K33N + 170G

| Sample | Sequence | Fold over 9B8 opt + K33N + 170G | | |
|---|---|---|---|---|
| | | E. coli | HEK293 | NIH3T3 |
| 1F7 (NF) | K43R, Y68D | 1.5 | 1.5 | 1.1 |
| 15H1 (NF) | D19D, S66N | 1.7 | 1.7 | 1.2 |

E. V2, 9B8 Opt+K33N+L27V+K43R+Y68D, 9B8 Opt+K33N+L27V+T39T+K43R+S66N and L27V

The variants 9B8 opt+K33N+T39T+K43R+Y68D ("V2"; SEQ ID NOs: 92 and 93), 9B8 opt+K33N+L27V+K43R+Y68D (SEQ ID NOs: 339 and 340), 9B8 opt+K33N+L27V+T39T+K43R+S66N (SEQ ID NOs: 341 and 342), and 9B8 opt+K33N+L27V+T39T+K43R+Y68D ("L27V"; SEQ ID NOs: 88 and 89) were subcloned into the Id-OgLuc-HT7 sandwich background as described above and assayed in HEK293 and NIH3T3 cells as described above. The luminescence generated by the sandwiched variants were compared to the luminescence generated by the 9B9 opt+K33N sandwich (SEQ ID NOs: 59 and 60) (Table 38). The L27V sandwich (SEQ ID NOs: 90 and 91) and V2 sandwich (SEQ ID NOs: 94 and 95) had at least 1.3× fold-increase in luminescence in HEK293 and NIH3T3 cells.

TABLE 38

Increase in Luminescence Generated by OgLuc variants in sandwich background compared to 9B8 opt + K33N in sandwich background

| Sample | NIH 3T3 cells | HEK 293 |
|---|---|---|
| K33N Sand | 1.0 | 1.0 |
| T39T, K43R, Y68D Sand | 1.6 | 2.3 |
| L27V, K43R, Y68D Sand | 1.4 | 1.7 |
| L27V, T39T, K43R, S66N Sand | 0.7 | 0.7 |
| L27V, T39T, K43R, Y68D Sand | 1.4 | 1.7 |

The sandwich and non-sandwich versions of the variants V2, 9B8 opt+K33N+L27V+K43R+Y68D, 9B8 opt+K33N+L27V+T39T+K43R+S66N, and L27V were assayed in HEK293 and NIH3T3 cells as described in Example 37. The luminescence generated by the non-sandwiched variants was compared to the luminescence generated by the sandwiched variants (Table 39). The data shown in Table 39 indicates that the fold-decrease in luminescence for the 9B8 opt+K33N sandwich was less in mammalian cells than in E. coli cells as shown in FIG. 70.

TABLE 39

Fold-Decrease in Luminescence of the OgLuc Variants in the Presence of Sandwich Background

| Sample | NIH 3T3 cells | HEK 293 |
|---|---|---|
| K33N | 29 | 15 |
| T39T, K43R, Y68D | 20 | 6 |

TABLE 39-continued

Fold-Decrease in Luminescence of the OgLuc Variants in the Presence of Sandwich Background

| Sample | NIH 3T3 cells | HEK 293 |
|---|---|---|
| L27V, K43R, Y68D | 22 | 8 |
| L27V, T39T, K43R, S66N | 25 | 12 |
| L27V, T39T, K43R, Y68D | 18 | 6 |

Example 46—Multiplexing

A. Lysates of *E. coli* expressing the variant 9B8 opt were prepared as previously described in Example 27 and diluted 1000-fold in DMEM without phenol red+0.1% PRIONEX®. Luminescence from a sample containing 6.3 µg/mL of purified red click beetle luciferase and *E. coli* lysate expressing the variant 9B8 opt was detected using a modified DUAL-GLO® Luciferase Assay System (Promega Corp.). DUAL-GLO® STOP&GLO® Reagent containing 20 µM coelenterazine-h and DUAL-GLO® STOP&GLO® Reagent containing 20 µM PBI 3939 were used, according to the manufacturer's protocol, to detect the red click beetle luciferase and OgLuc variant 9B8 luciferase from a single sample. Three replicates were performed.

Luminescence was detected on a Turner MODULUS™ luminometer. Table 40 shows the average luminescence generated by the red click beetle luciferase ("click beetle"), and the luminescence generated by 9B8 opt ("Ogluc") with coelenterazine-h ("coel h") or PBI-3939 ("3939"). The standard deviation ("+/−") and coefficient of variance ("CV") are also shown. A "no coelenterazine" control was performed to illustrate the amount of quenching of the red click beetle signal by the DUAL-GLO® STOP&GLO® Reagent of the DUAL-GLO® Luciferase Assay System in the absence of coelenterazine. The "no coelenterazine" control yielded a 349-fold quench. Table 40 shows that large luminescent signals from both the red click beetle and OgLuc variant 9B8 was detected in a single sample. This demonstrates that each signal can be read sequentially in a two-step assay, and the signal from the first enzyme can be quenched enough to not contribute significantly to the signal from the second enzyme.

TABLE 40

Average Luminescence Generated by the Red Click Beetle and 9B8 opt Luciferases Using a Modified DUAL-LUCIFERASE ™ Reporter Assay

| | click beetle | +/− | CV | Ogluc | +/− | CV | fold-quench | +/− coel |
|---|---|---|---|---|---|---|---|---|
| no coel | 5,061,163 | 147,146 | 2.9% | 14,504 | 214 | 1.5% | 349 | |
| coel h | 5,082,100 | 152,254 | 3.0% | 921,440 | 47,623 | 5.2% | | 64 |
| 3979 | 5,078,547 | 41,753 | 0.8% | 2,996,940 | 187,300 | 6.2% | | 207 |

B. To demonstrate that the multiplex reporter assay described above could be done in reverse, i.e., OgLuc luminescence detected first, quenched and a second luminescence detected, e.g., red click beetle or firefly luciferase, various *Renilla* luciferase inhibitors (see U.S. Published Application No. 2008/0248511) were screened for their ability to also inhibit OgLuc. Two different, previously identified, *Renilla* inhibitors, PBI-3077 and 1424, were added at various concentrations (see Table 41) to *E. coli* lysate samples expressing the variant 9B8 (diluted as above) and a buffer containing 100 mM MES pH 6.0, 1 mM CDTA, 150 mM KCl, 35 mM Thiourea, 2 mM DTT, 0.25% TERGITOL® NP-9 (v/v), 0.025% MAZU® DF 204, and 20 nM PBI-3939. Luminescence was measured as described previously except luminescence was measured using the GLO-MAX®-Multi Microplate luminometer (Promega Corp.; also known as Turner MODULUS™). As shown in Table 41, both compounds were able to inhibit OgLuc luminescence. This demonstrates that an OgLuc variant can be multiplexed in a reporter assay with another luciferase wherein luminescence from an OgLuc variant is detected first in the reporter assay.

TABLE 41

The effect of PBI-3077 and PBI-1424 on Luminescence Generated by Bacterial Lysates Expressing 9B8 opt Using PBI-3939 as a Substrate

| | (mM or %) | RLU | +/− | % |
|---|---|---|---|---|
| | control | 27,794,600 | 626,862 | 100% |
| AI (3077) | 3 | 15,473,100 | 209,567 | 56% |
| mM | 0.3 | 22,210,433 | 102,888 | 80% |
| | 0.03 | 22,484,933 | 927,459 | 81% |
| AC (1424) | 0.4 | 176,868 | 9,579 | 0.64% |
| % | 0.04 | 24,267,533 | 363,861 | 87% |
| | 0.004 | 25,126,900 | 1,569,453 | 90% |

Figure 71:
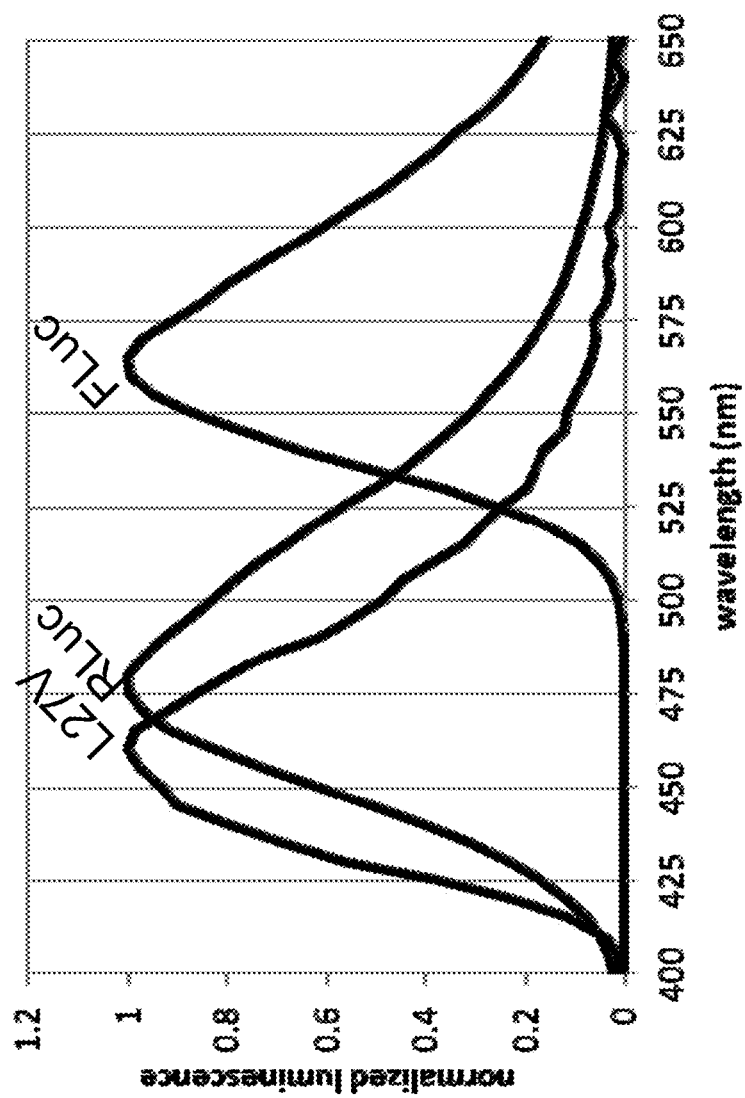
FIG. 71 shows the spectral profile of the OgLuc variant L27V.

C. The spectral resolution between OgLuc Variant L27V and firefly luciferase (Flue) was analyzed. Purified L27V (previously described; 9.54 µM) in DMEM without phenol red+0.1% PRIONEX® was mixed with assay reagent (previously described) containing 20 µM PBI-3939. Purified firefly luciferase enzyme (QUANTILUM® Recombinant Luciferase; Promega Corp.; 271 ng/mL) in the same media was mixed with a test reagent (100 mM HEPES, pH 7.4, 1 mM CDTA, 16 mM MgSO4, 1% TERGITOL® NP-9 (v/v), 0.1% MAZU® DF 204, 5 mM ATP, 50 mM DTT, 333 µM luciferin). Purified *Renilla* luciferase (5 ng/mL GST-*Renilla*) in 1× *Renilla* Luciferase Assay Lysis Buffer (Promega Corp.) was mixed with 10.5 µM native coelenterazine in *Renilla* Luciferase Assay Buffer. Luminescence was measured after 3 min for L27V and Fluc and after 10 min for *Renilla* luciferase (FIG. 71)

D. As another example, an OgLuc variant of the present invention could be used as transcriptional reporter and paired with either aequorin or a cAMP circularly permuted firefly luciferase biosensor (or both simultaneously) to detect multiple pathways in a single sample, e.g., aequorin for the detection and/or measurement of calcium, the biosensor for the detection and/or measurement of cAMP, and an OgLuc variant for monitoring of downstream gene expression.

E. Other examples for multiplexing with the OgLuc variants of the present invention include:

i) Transfecting cells with constructs containing an OgLuc variant of the present invention and Firefly luciferase. After transfection, a first reagent could be added to lyse the cells as well as provide the substrate to generate luminescence for the first luciferase. Luminescence from the first luciferase would then be measured. A second reagent would then be added to quench luminescence from the first luciferase as well as provide the substrate to generate luminescence from the second luciferase. Luminescence from the second luciferase would then be measured. The choice of which luciferase to measure first would only depend on the ability to quench the luminescence from the first luciferase with the second reagent. For this example, luminescence from the OgLuc variant could be measured first as high concentrations of luciferin (substrate for firefly luciferase) has been shown to inhibit OgLuc variant activity.

ii) Transfecting cells with constructs containing an OgLuc variant of the present invention and Firefly luciferase. After transfection, a first reagent could be added which contained a live cell substrate to generate luminescence for the first luciferase. Luminescence from the first luciferase would then be measured. A second reagent would then be added to lyse the cells, quench luminescence from the first luciferase and provide the substrate to generate luminescence from the second luciferase. Luminescence from the second luciferase would then be measured. This is similar to i) except cell lysis will further limit usage of the live cell substrate and contribute to the quenching of luminescence from the first luciferase.

iii) Transfecting cells with constructs containing an OgLuc variant of the present invention and Firefly luciferase. After transfection, one reagent could be added which contained substrates to generate luminescence from both luciferases, but the luminescence from each luciferase is spectrally different. The emission max of the OgLuc variants is approximately 460 nm, and certain substrates for Firefly luciferase, for example 5'-chloroluciferin and 5'-methylluciferin, can yield an emission max of approximately 610 nm. Therefore, although there may be some overlap from the blue emission into the red emission, there would be no overlap of the red emission into the blue emission suggesting that little to no mathematical correction would be involved.

iv) Transfecting cells with constructs containing an OgLuc variant of the present invention and Firefly luciferase. After transfection, one reagent could be added which contained live cell substrates to generate luminescence from both luciferases. The unique feature of this example is that firefly luminescence tends to shift to red at live cell assay temperatures, e.g., 37° C., therefore, a number of different luciferin derivatives could be chosen as a live cell substrate for firefly luciferase to generate luminescence which is spectrally different from that of the OgLuc variant.

v) Transfecting cells with constructs containing an OgLuc variant of the present invention and *Renilla* luciferase. After transfection, a first reagent could be added to lyse the cells as well as provide the substrate to generate luminescence for the first luciferase. Luminescence from the first luciferase would then be measured. A second reagent would then be added to quench luminescence from the first luciferase as well as provide the substrate to generate luminescence from the second luciferase. Luminescence from the second luciferase would then be measured. The choice of which luciferase to measure first would only depend on the ability to quench the luminescence from the first luciferase with the second reagent. For this example, inhibitors to quench either the OgLuc variant or *Renilla* luciferase luminescence would need to be used.

vi) Transfecting cells with constructs containing an OgLuc variant of the present invention and click beetle luciferase. After transfection, one reagent could be added which contained substrates to generate luminescence from both luciferases, but the luminescence from each luciferase is spectrally different as click beetle luciferase generates red-shifted luminescence with native luciferin.

Example 47—Circular Permutation

Two circularly permuted (CP) versions of the L27V variant were made: CP84 and CP95. The number designation refers to the N-terminal residue (e.g., "84" indicates the new N-terminus of the CP version).

Figure 72:
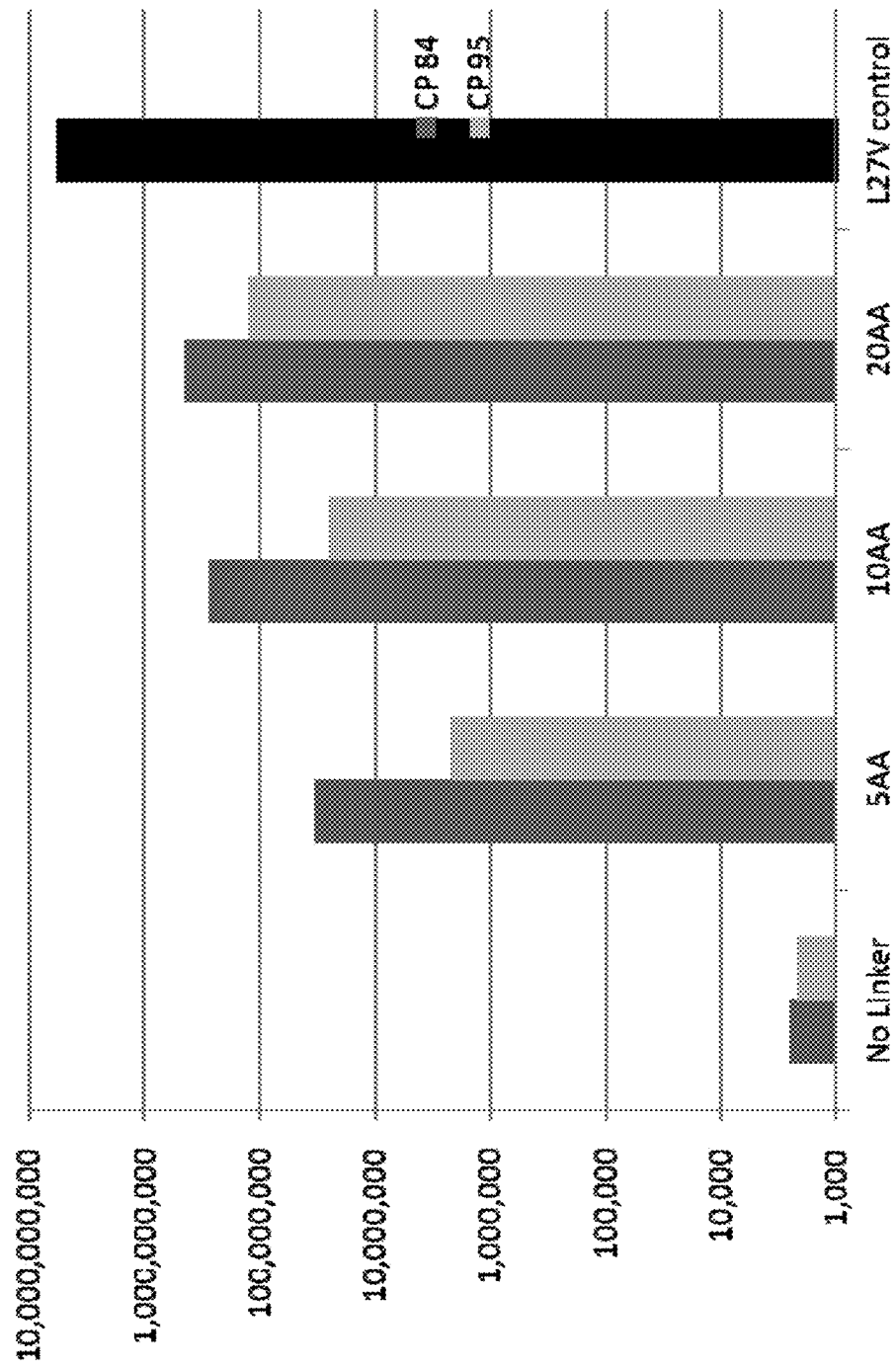
FIG. 72 shows the luminescence of two circulated permuted (CP) versions of the OgLuc variant L27V, CP84 and CP95, either with no linker or with a 5, 10, or 20 amino acid linker.

To create the circular permutations, the prior N- and C-termini are fused together with no linker ("CP84 no linker" (SEQ ID NOs: 97 and 98) and "CP95 no linker" (SEQ ID NOs: 105 and 106)) or a 5 ("CP84 5AA linker" (SEQ ID NOs: 99 and 100) and "CP95 5AA linker" (SEQ ID NOs: 107 and 108), 10 ("CP84 10AA linker" (SEQ ID NOs: 101 and 102) and "CP95 10AA linker" (SEQ ID NOs: 109 and 110), or 20 ("CP84 20AA linker" (SEQ ID NOs: 103 and 104) and "CP95 20AA linker" (SEQ ID NOs: 111 and 112) amino acid linker, (GSSGG)n (SEQ ID NO: 113) in between the N- and C-termini ends. (Note: L27V starts with the phenylalanine at the N-terminus, i.e., MVF. The "MV" is present in the "no linker" construct, but not in the "linker" constructs). Once circularly permuted, the CP L27V variants were cloned into the pF1K vector. *E. coli* cells were transformed with the CP vectors and grown in minimal media using the standard walk away induction protocol previously described. For each CP construct, cells were grown in 8 wells of a 96-well plate. After induction, the 8 wells from each sample were pooled, and 10 µL lysed in 40 µL lysis buffer (100 mM MES pH 6.0, 0.3×PLB, 0.3 mg/mL lysozyme, 0.003 U/µL DNase I, and 0.25% TERGITOL® NP-9 (v/v)). The lysates were then diluted 1:100 (CP versions with linker) or 1:1000 (non-CP versions) in lysis buffer. The CP version without linker was not diluted. The lysates or lysate dilutions were assayed in triplicate in 50 µL assay reagent (previously described). Luminescence was measured as previously described (FIG. 72).

Example 48—Identifying Additional Sites for Circular Permutation

Figure 73A:
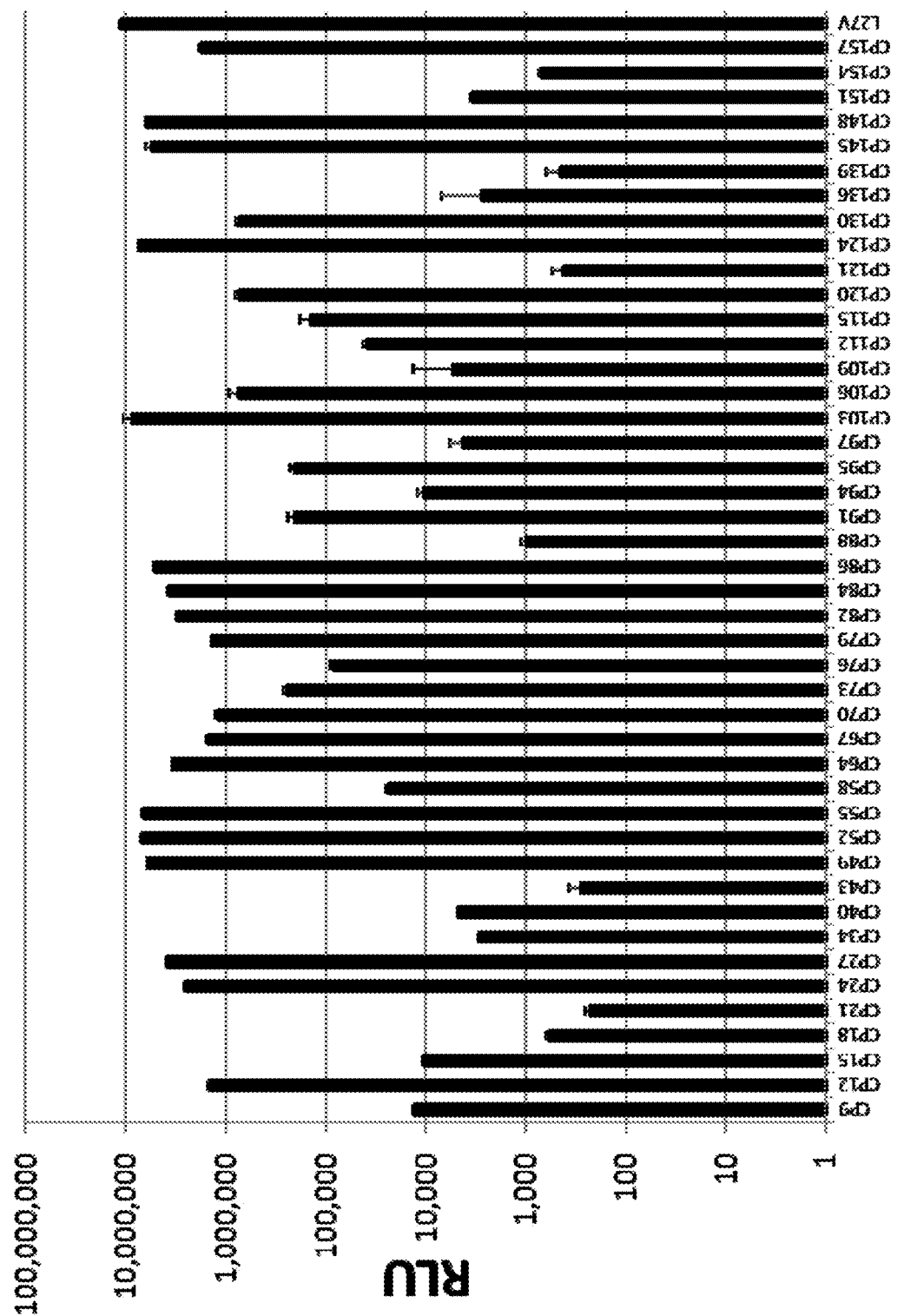
FIGS. 73A-G show the luminescence of the various CP-TEV protease L27V constructs expressed in wheat germ extract (FIGS. 73A-D), *E. coli* (FIGS. 73F-G) and HEK 293 cells (FIG. 73H).
Figure 73B:
Figure 73C:
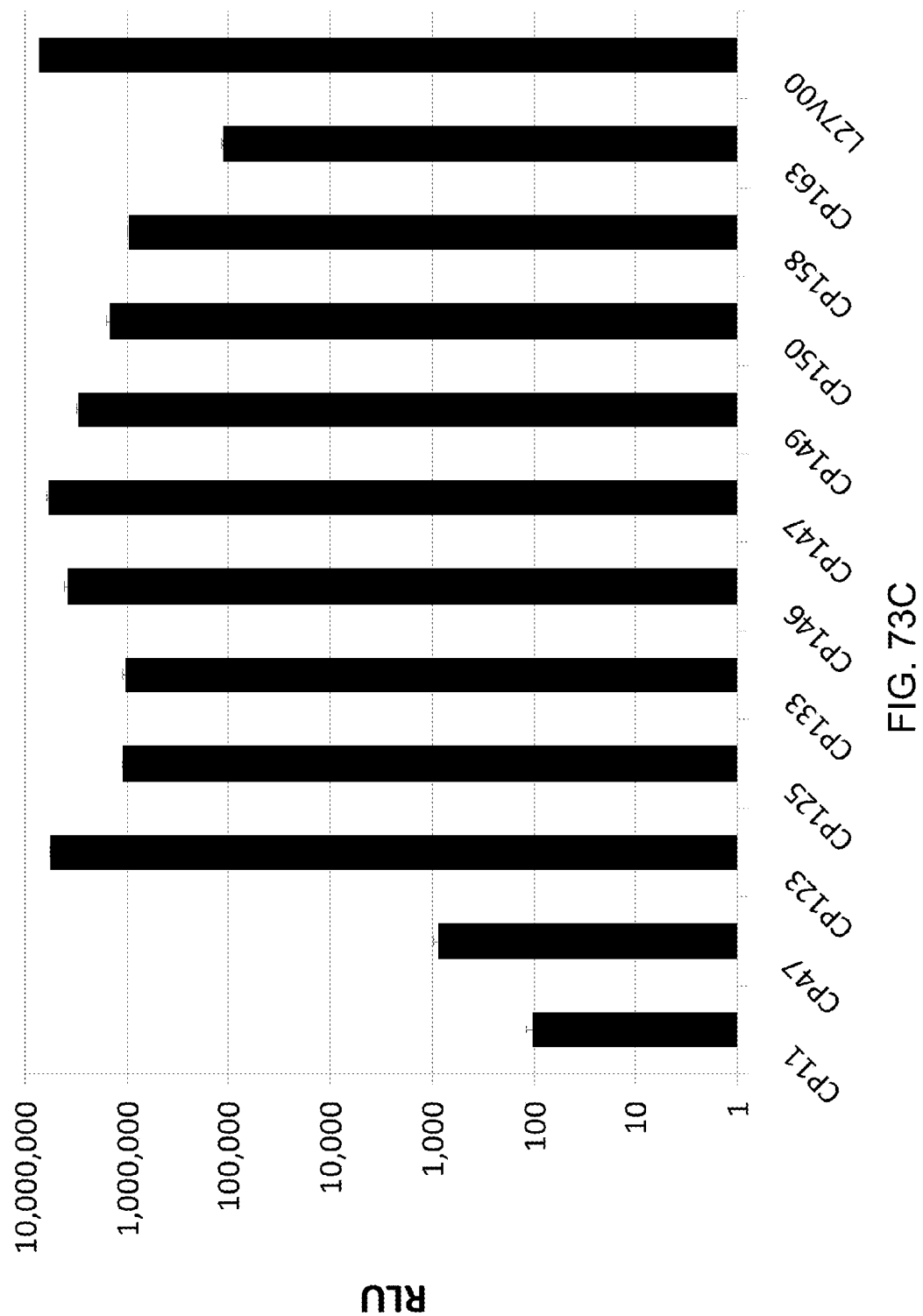
Figure 73D:
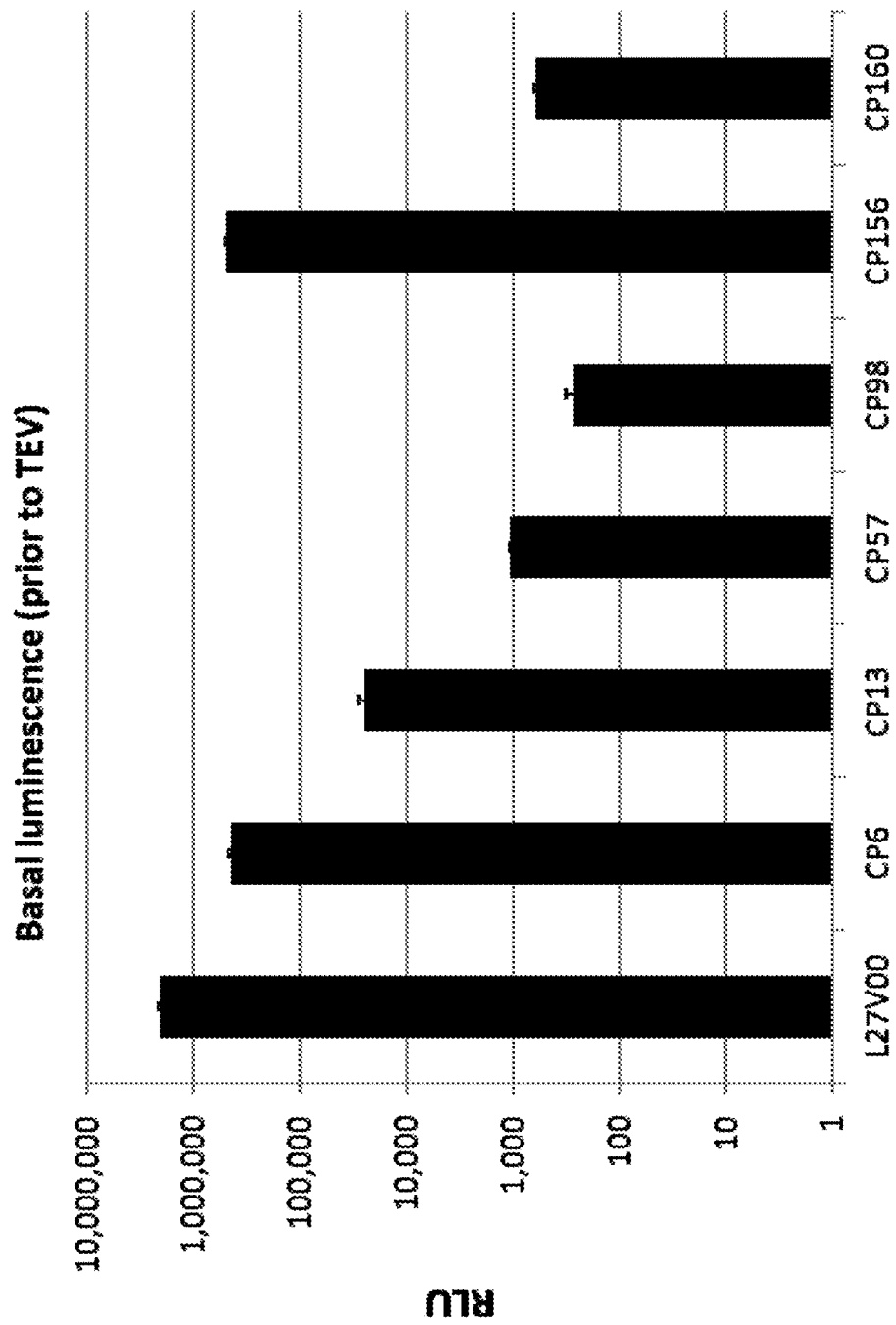
Figure 73:
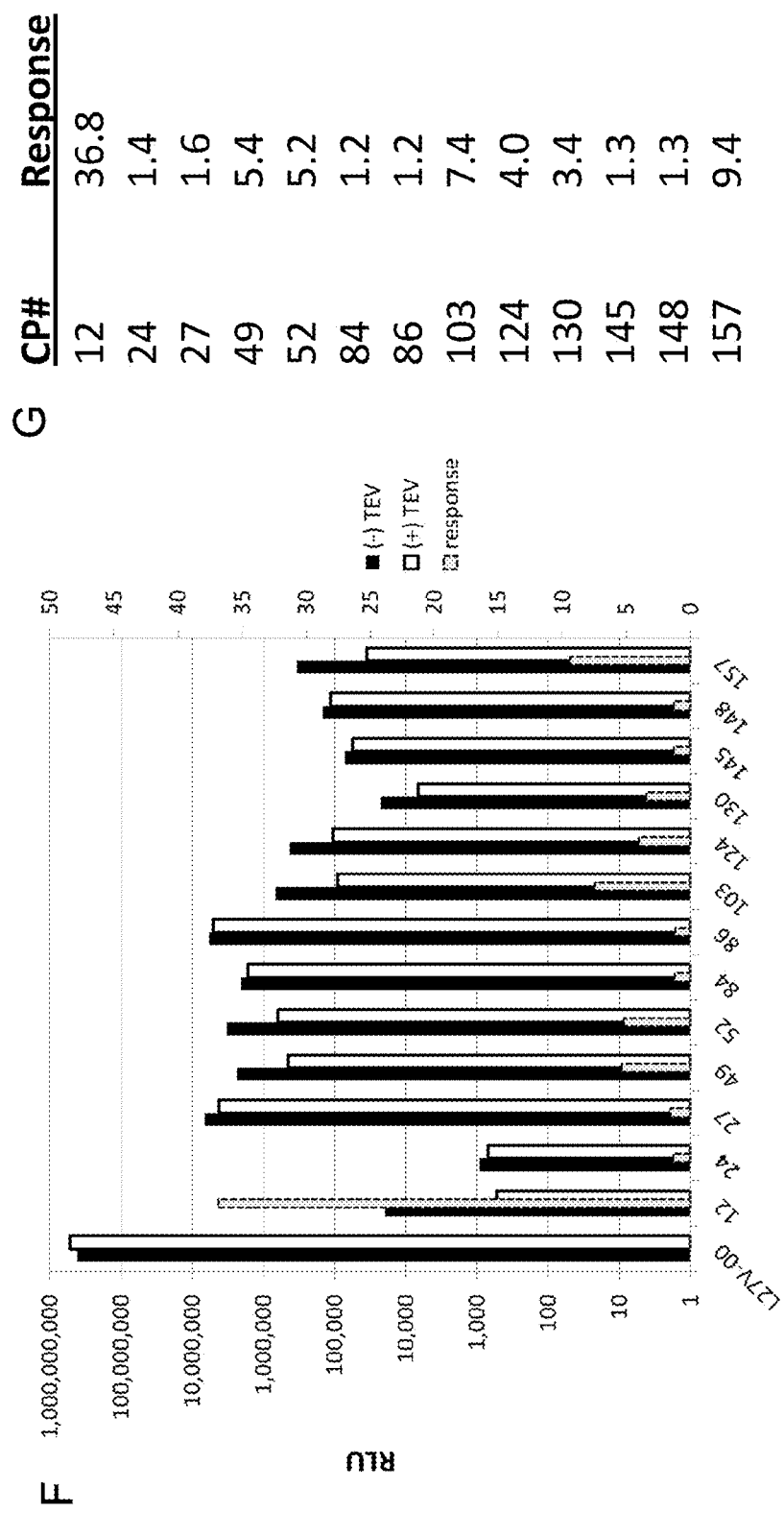
Figure 73H:
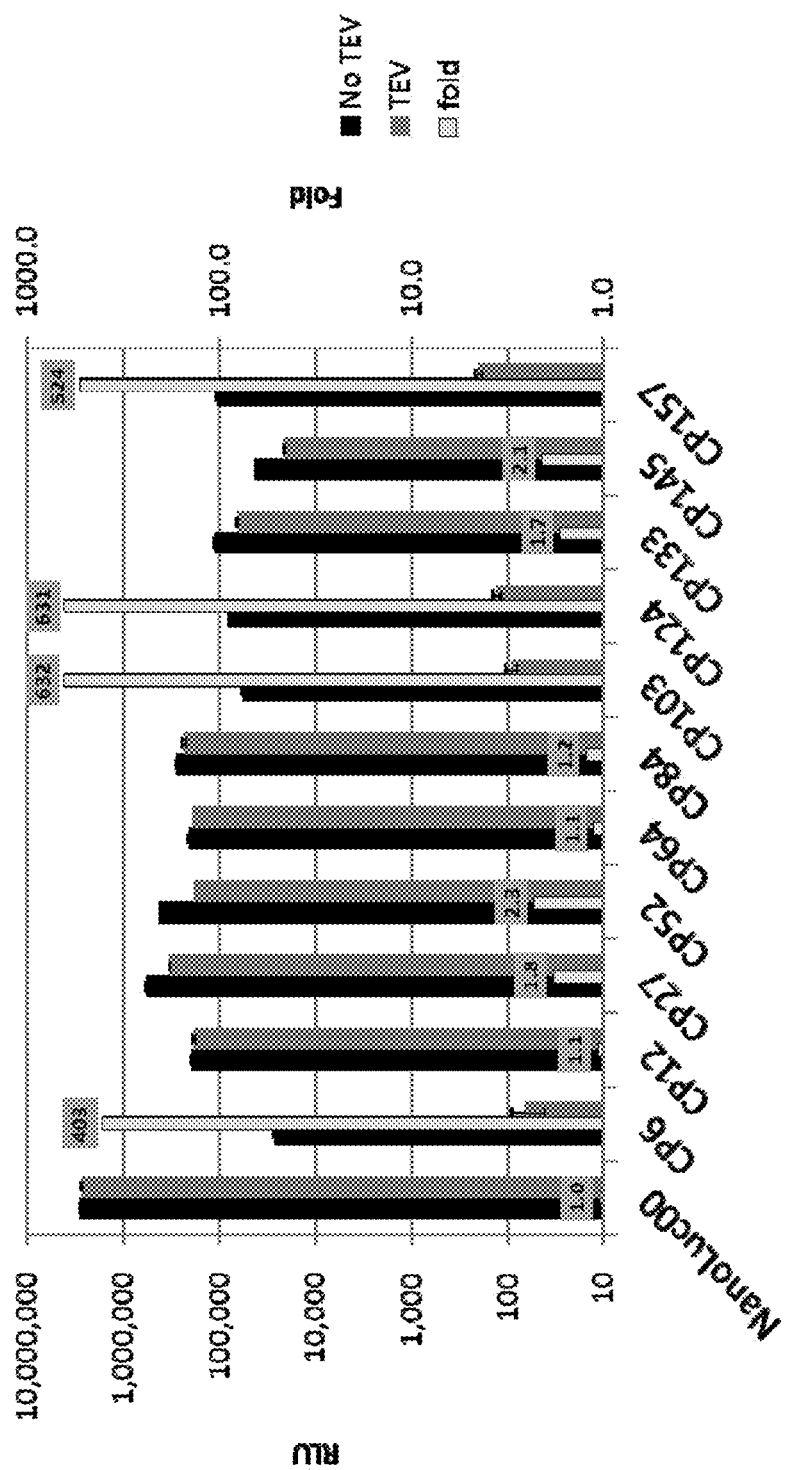

To identify additional CP sites, determine the impact of the CP sites on luciferase activity and investigate the use of a "tether" between fragments, CP constructs were made with a circular permutation made at approximately every $3^{rd}$ site (i.e., amino acid) of the L27V variant (See FIG. 73E). One skilled in the art would understand that other sites, e.g., the $1^{st}$ and $2^{nd}$ site, could also be tested and used in circular permuted OgLuc variants described herein using the methods described here. For example, the L27V variant has been found to be particularly tolerant to circular permutation, particularly situations in which a relatively large binding domain is placed in between the permuted fragments (e.g. cAMP/RIIbB-based sensors). At each site, the linker GSSGG-GSSGG-EPTT-<u>ENLYFQS</u>-DN-GSSGG-GSSGG (SEQ ID NO: 328) was added. The underscored sequence refers to a TEV protease recognition site. The purpose of the linker is to provide a long enough tether between the two variant fragments so they can associate in a way that produces a functional luciferase enzyme. The TEV protease recognition site was used to provide a means to disrupt the tether (in the presence of TEV protease) so that its importance to maintaining activity could be investigated. The use of the TEV protease recognition site created a mode to predict which CP sites would be useful for protein complementation assays (PCA) or for biosensor applications (e.g., insertion of a response element between the CP sites).

The activity that is seen prior to TEV cleavage represents how the two halves of the variant enzyme behaves in a tethered state. TEV binding to the recognition site causes cleavage, thereby separating the two halves of the variant enzyme. Samples that have been cleaved with TEV would represent the un-induced state and provide an indication of how much background could be expected. Lower activity after TEV cleavage indicates that the two halves cannot come together without induction. Samples that show a large loss in activity after TEV cleavage indicate sites that would function in PCA and biosensor applications. In the case of PCA, the two halves of the variant enzyme would be fused to binding partners that are able to come together (tether) after an induced binding event. In the case of a biosensor, the two halves would "tether" after a binding-induced conformational change occurs. One example for PCA would be to fuse one half of L27V to FRB and the other half to FKBP. The two halves would be brought into proximity with exposure to rapamycin (Banaszynski et al., *J. Am. Chem. Soc,* 127(13):4715-4721 (2005)). One example of a biosensor application would be to insert a Cyclic AMP binding domain (e.g., RIIbB) between the CP sites and induce a conformational change by binding of Cyclic AMP to the binding domain.

Once each CP L27V construct was made, the CP enzyme was expressed in wheat germ, *E. coli* and mammalian cells and digested with TEV protease to investigate luciferase activity.

1. For analysis in wheat germ, the CP constructs were expressed using the TnT® T7 Coupled Wheat Germ Extract System (Promega Corp.) according to the manufacture's instructions. The TnT® reactions were then diluted 1:100 in 1×PBS+0.1% gelatin, and 20 μL added to 25 μL of TEV reaction reagent (5 μL 20× ProTEV buffer (Promega Corp.), 1 μL 100 mM DTT, and 2 μL 10 U ProTEV Plus (Promega Corp.)). The volume of the digestion reactions was the brought to 100 μL with water and incubated at 30° C. for 60 min. Control samples without TEV protease were also prepared. 10 μL of the digested samples were then added to 40 μl DMEM to a final volume of 50 μL and assayed in 50 μL assay reagent (as previously described; 100 μM PBI-3939). Luminescence was measured as previously described (FIGS. 73A-D).

2. For analysis in mammalian cells, HEK293 cells were transfected with the CP L27V variants using a reverse transfection protocol. Briefly, 1 ng CP L27V plasmid DNA was mixed with 1 μg carrier DNA and added to cells in a well of a 12-well plate. Cells were then incubated for 16 hrs at 37° C., 5% $CO_2$. Cell lysates were then prepared by removing the media from the cells, washing them in 1×PBS, and adding 1 mL 1×PLB. Lysates were then diluted 1:10 in 1×PBS with 0.1% gelatin. 40 μL of the diluted lysate was then used in a TEV protease digestion as described above. 10 μL of the digestion was mixed with 40 μL DMEM without phenol red, and 50 μL assay reagent (previously described; 100 μM PBI-3939) added. Luminescence was measured as previously described (FIG. 73H).

3. For analysis in *E. coli, E. coli* cultures expressing the CP L27V variants were grown overnight at 30° C. These cultures were used (1:100 diluted in LB+antibiotic) to make new starter cultures for eventual induction. The starter cultures were incubated at 37° C. with shaking for 2.5 hrs ($OD_{600}$ is approximately 0.5). Rhamnose (final concentration of 0.2%) was added, the cultures moved to 25° C., and incubated with shaking for 18 hrs.

To create lysates, 50 μL 0.5× FASTBREAK™ Cell Lysis Reagent (Promega Corp.) was added to 950 μL of induced cultures, and the mixtures incubated for 30 min at 22° C. 50 μL of the lysed culture was then digested with TEV protease as described above and incubated at room temperature for 2 hrs.

For analysis, lysates were diluted 1:10,000 in HaloTag® Mammalian Purification Buffer (Promega Corp.), and 50 μL assayed in 50 μL of assay reagent (as previously described; 100 μM PBI-3939). Basal and TEV induced luminescence was measured at 5 min time points (FIG. 73F) and the response (FIG. 73G) was determined as previously described.

FIGS. 73A-D show the basal luminescence of various CP-TEV protease L27V constructs expressed in wheat germ extract. FIG. 73E summarizes the derived CP variants that responded to TEV protease (response is fold decreased), indicating that the CP variants can be used as TEV sensors, i.e., they are indicative of "tether dependence." Variants showing at least a 1.2-fold change were further validated as signification using Student's Test (unpaired p values; confidence level of 0.03). These results indicate that each CP variant is capable of generating luminescence.

Various CP-TEV protease L27V constructs were expressed in HEK293 cells. The reverse transfection protocol, previously described was used to transfect 1 ng DNA/well with 1 μg of carrier DNA. Each cell sample was grown in 1 mL of media in a 12 well plate. Cell lysates were prepared by removing media and adding 1 mL of 1×PLB. Samples were diluted 1:10 in 1×PBS+0.1% gelatin. 40 μL of the dilution sample was set up for TEV digestion. 10 μL of the digestion reaction was added to 40 μL of DMEM without phenol red and 50 μL of PBI-3939 as previously described. FIG. 73H shows the luminescence of the various CP-TEV protease L27V constructs expressed in HEK293 cells.

The data in FIGS. 73A-H demonstrates that the L27V variant can be circularly permuted at various sites, and different sites have different dependencies regarding tether length. The mammalian cell data and Wheat Germ data show similar fold reduction with TEV cleavage. The CP L27V variants that are more dependent on the tether, i.e., are more sensitive to TEV protease cleavage, are potential candidates for PCA. CP L27V variants that are less dependent on the tether may be potential candidates for self-complementation/dimerization assays.

Example 49—Protein Complementation Assays

Protein complementation assays (PCA) provide a means to detect the interaction of two biomolecules, e.g., polypeptides. PCA utilizes two fragments of the same protein, e.g., enzyme, that when brought into close proximity with each other can reconstitute into a functional, active protein. An OgLuc variant of the present invention can be separated into two fragments at a site(s) tolerant to separation. Then, each fragment of the separated OgLuc variant can be fused to one of a pair of polypeptides of interest believed to interact, e.g., FKBP and FRB. If the two polypeptides of interest do in fact interact, the OgLuc fragments then come into close proximity with each other to reconstitute the functional, active OgLuc variant. The activity of the reconstituted OgLuc variant can then be detected and measured using a native or known coelenterazine or a novel coelenterazine of the present invention. In another example, the split OgLuc variant can be used in a more general complementation system similar to lac-Z (Langley et al., *PNAS,* 72:1254-1257 (1975)) or ribonuclease S (Levit and Berger, *J. Biol. Chem.,*

251:1333-1339 (1976)). Specifically, an OgLuc variant fragment (designated "A") known to complement with another OgLuc variant fragment ("B") can be fused to a target protein, and the resulting fusion can be monitored via luminescence in a cell or a cell lysate containing fragment B. The source of fragment B could be the same cell (either in the chromosome or on another plasmid), or it could be a lysate or purified protein derived from another cell. This same fusion protein (fragment A) could be captured or immobilized using a fusion between fragment B and a polypeptide such as HALOTAG® capable of attachment to a solid support. Luminescence can then be used to demonstrate successful capture or to quantitate the amount of material captured. Methods for protein complementation can be carried out according to U.S. Published Application No. 2005/0153310, incorporated herein by reference.

1. 9B8 Opt PCA Constructs were Made as Follows:

```
                                    (SEQ ID NOs: 331 and 332)
p9B8PCA ¼ = pF5A/Met-[9B8 opt (51-169)]-
GGGGSGGGSS-FRB
&
                                    (SEQ ID NOs: 337 and 338)
pF5A/FKBP-GGGSSGGGSG-[9B8 opt (1-50)]

(SEQ ID NOs: 331 and 332)
p9B8PCA ½ = pF5A/Met-[9B8 opt (51-169)]-
GGGGSGGGSS-FRB
&
                                    (SEQ ID NOs: 333 and 334)
pF5A/[9B8 opt (1-50)]-GGGGSGGGSS-FRB (SEQ ID NOs: 333 and 334)
p9B8PCA ⅔ = pF5A/[9B8 opt (1-50)]-GGGGSGGGSS-FRB
&
                                    (SEQ ID NOs: 335 and 336)
pF5A/FKBP-GGGSSGGGSG-[9B8 opt (51-169)]

(SEQ ID NOs: 335 and 336)
p9B8PCA ¾ = pF5A/FKBP-GGGSSGGGSG-[9B8 opt
(51-169)]
&
                                    (SEQ ID NOs: 337 and 338)
pF5A/FKBP-GGGSSGGGSG-[9B8 opt (1-50)]
```

Figure 74:
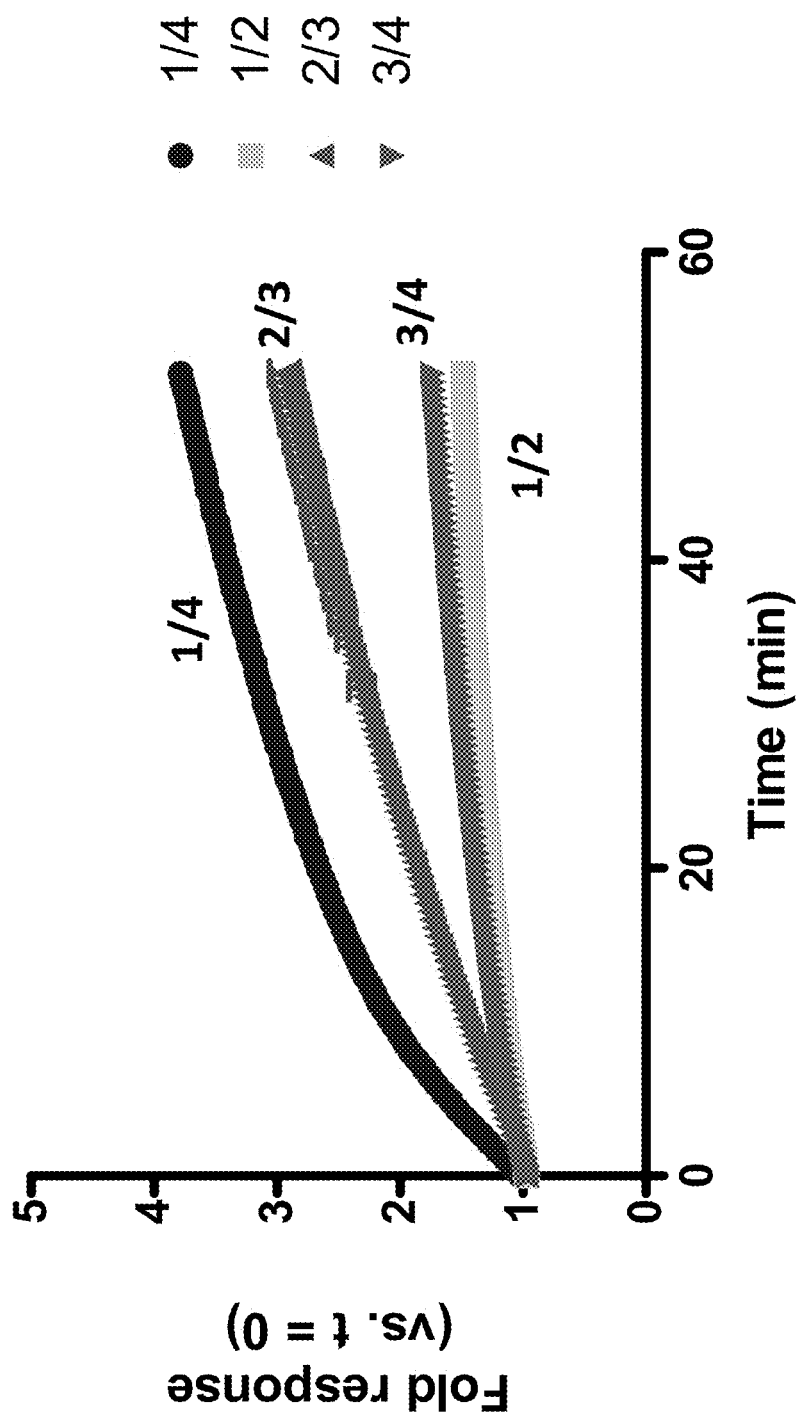
FIG. 74 shows the fold response of various protein complementation L27V pairs.
Figure 75A:
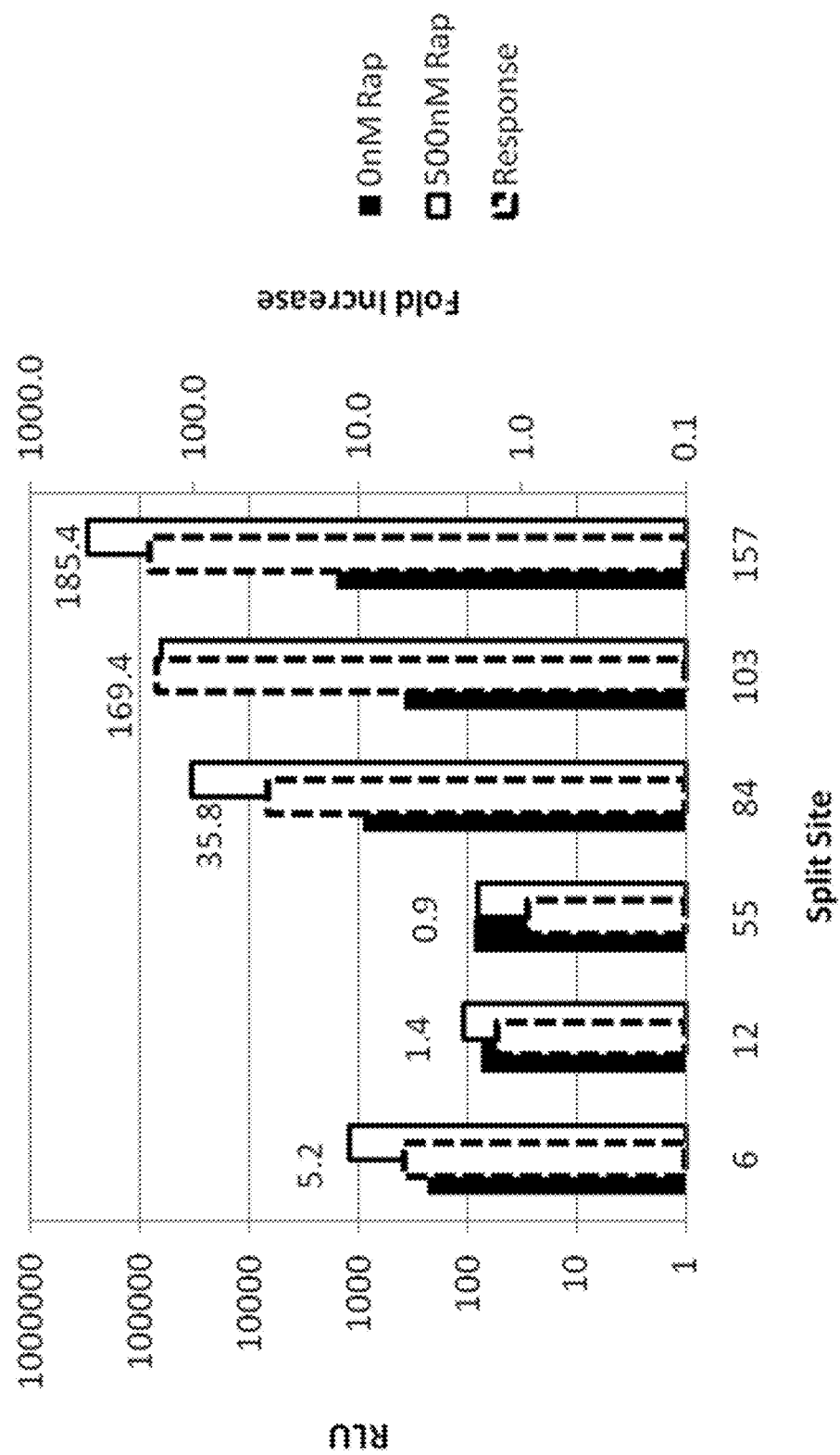
FIGS. 75A-C show the luminescence of various protein complementation (PCA) L27V pairs: one L27V fragment of each pair was fused to either FKBP or FRB using a ¼ configuration (FIG. 75A) or a ⅔ configuration (FIG. 75B), and the interaction of FKBP and FRB monitored in HEK 293 cells. The luminescence of various protein complementation (PCA) negative controls was also monitored (FIG. 75C).
Figure 75B:
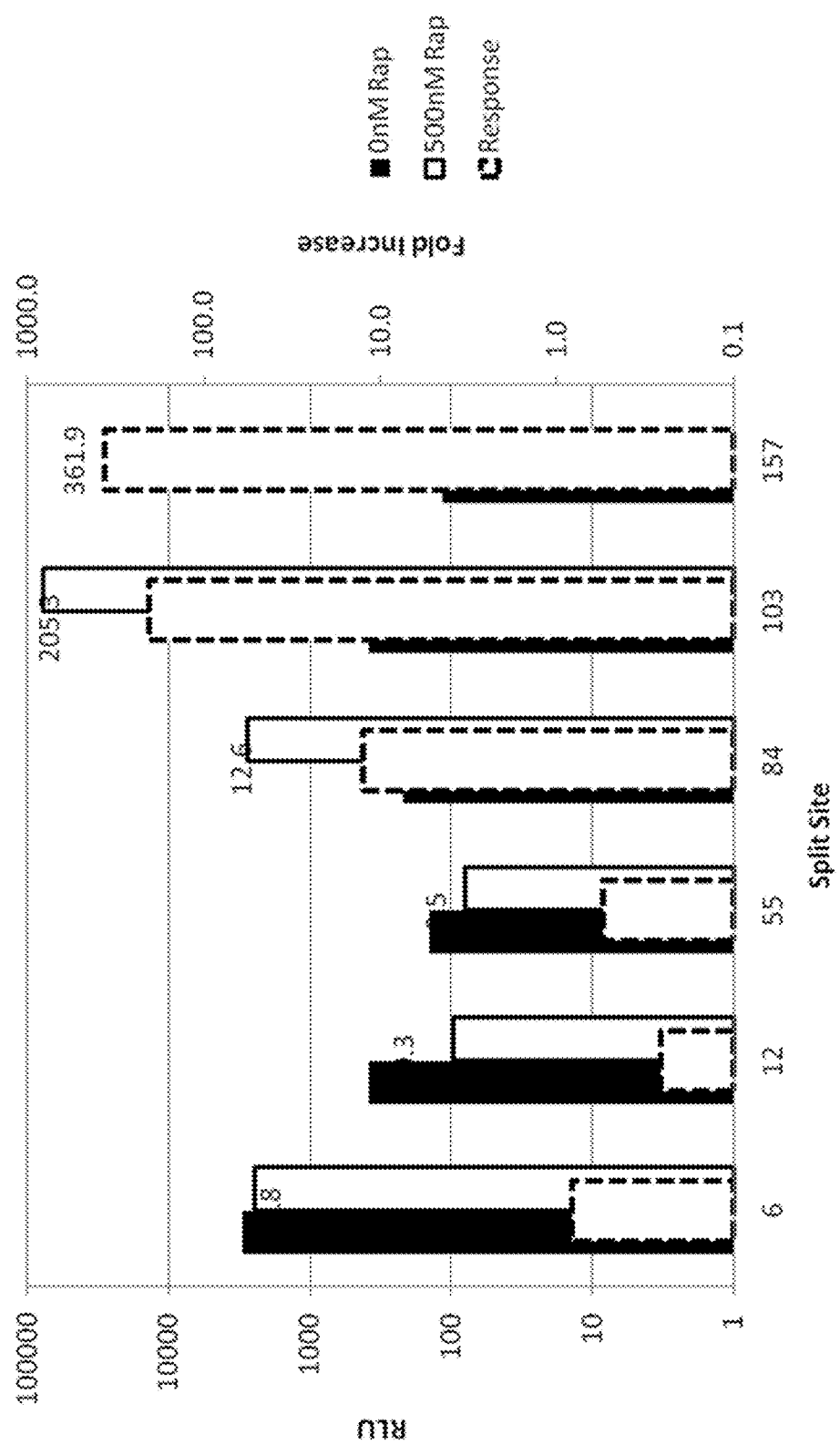
Figure 75C:
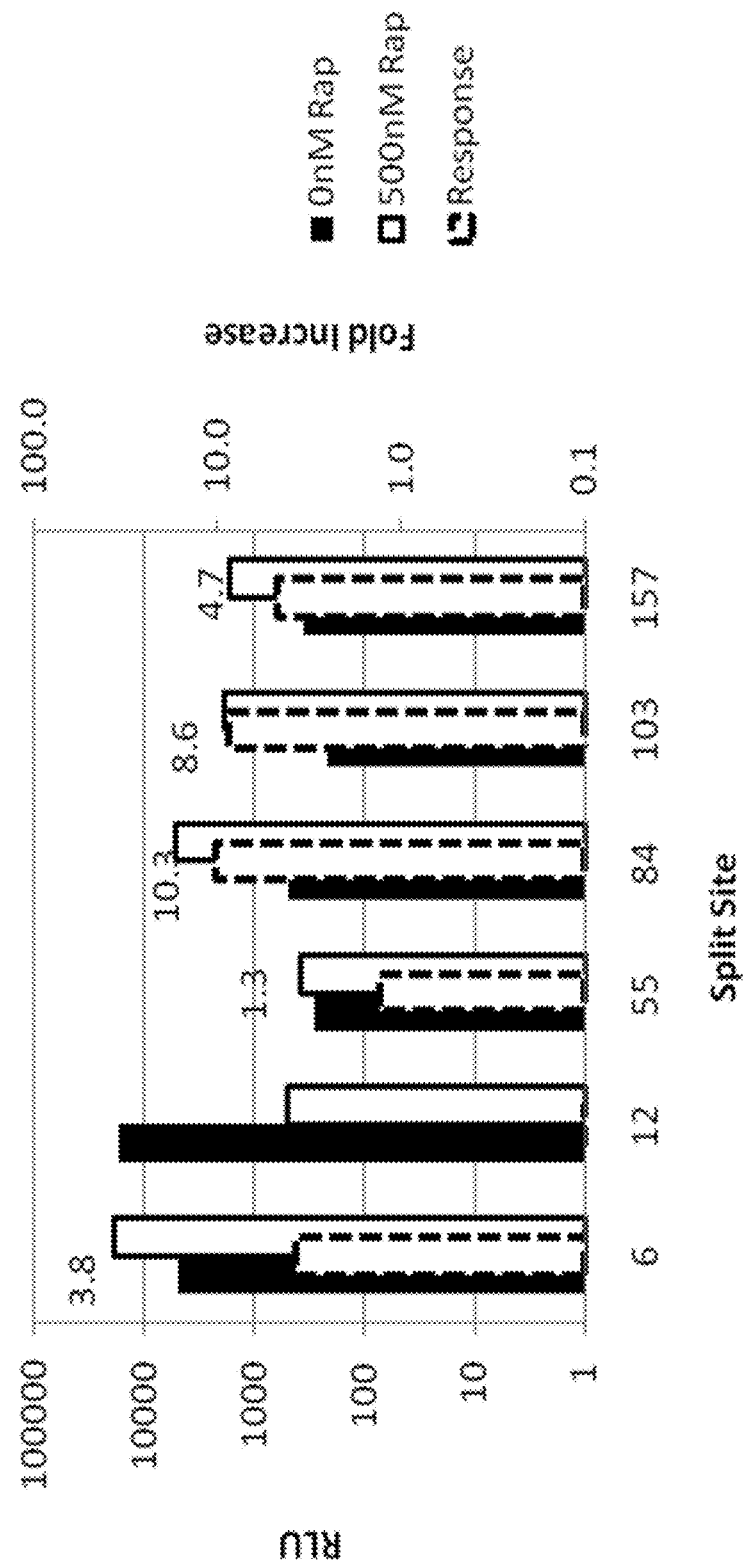

The PCA constructs were transfected into HEK293 cells (15,000 cells/well) into a 96-well plate using FUGENE® HD according to the manufacturer's instructions. The cells were then incubated overnight at 37° C., 5% $CO_2$. After transfection, the media on the cells was replaced with $CO_2$-independent media with 10% FBS. Assay reagent with 20 µM PBI-3939 was then added, and luminescence measured on a Varioskan Flash at 28° C. 100 µM rapamycin was then added to the wells, and luminescence continuously measured for 1 hr. Fold response was calculated by dividing all luminescence of a given well by the pre-rapamycin treatment luminescence for the same well (FIG. 74).

2. To demonstrate the use of the OgLuc variants in PCA, the L27V02A variant fragments were complemented with FKBP or FRB, and the interaction between FKBP and FRB measured.

Table 42 lists the various protein complementation (PCA) constructs made and tested. "⅔" designates the variant complementation pairs where 1) the "old" C-terminus of L27V02A ("old"=original C-terminus of L27V02A) is the C-terminal partner of FKBP; and 2) the "old" N-terminus of L27V02A is the N-terminal partner of FRB. "¼" designates the variant pairs where 1) the "old" N-terminus of L27V02A is the C-terminal partner of FKBP; and 2) the "old" C-terminus of L27V02A is the N-terminal partner of FRB. For all constructs, FKBP was located at the N-terminus of the L27V02A fragment, and FRB was located at the C-terminus of the L27V02A fragment. For example, PCA constructs were made with split sites at position 157 (see Table 42, "⅔" and "¼" #s 11 and 12 (SEQ ID NOs: 288-295)), 103 (see Table 42, "⅔" and "¼" #s 9 and 10 (SEQ ID NOs: 296-303)), and 84 (see Table 42, "⅔" and "¼" #s 7 and 8 (SEQ ID NOs: 304-315)). Other PCA constructs were made (SEQ ID NOs: 343-426 and 428-440) (See Table 21)

TABLE 42

| "2/3" | "1/4" |
|---|---|
| 1. FKBP-L27V 6-169 | 1. FKBP-L27V 1-5 |
| 2. L27V 1-5-FRB | 2. L27V 6-169-FRB |
| 3. FKBP-L27V 12-169 | 3. FKBP-L27V 1-11 |
| 4. L27V 1-11-FRB | 4. L27V 12-169-FRB |
| 5. FKBP-L27V 55-169 | 5. FKBP-L27V 1-54 |
| 6. L27V 1-54-FRB | 6. L27V 55-169-FRB |
| 7. FKBP-L27V 84-169 | 7. FKBP-L27V 1-83 |
| 8. L27V 1-83-FRB | 8. L27V 84-169-FRB |
| 9. FKBP-L27V 103-169 | 9. FKBP-L27V 1-102 |
| 10. L27V 1-102-FRB | 10. L27V 103-169-FRB |
| 11. FKBP-L27V 157-169 | 11. FKBP-L27V 1-156 |
| 12. L27V 1-156-FRB | 12. L27V 157-169-FRB |

| "2/3" | "1/4" |
|---|---|
| 1. FKBP-L27V 6-169 | 1. FKBP-L27V 1-5 |
| 2. L27V 1-5-FRB | 2. L27V 6-169-FRB |
| 3. FKBP-L27V 12-169 | 3. FKBP-L27V 1-11 |
| 4. L27V 1-11-FRB | 4. L27V 12-169-FRB |
| 5. FKBP-L27V 55-169 | 5. FKBP-L27V 1-54 |
| 6. L27V 1-54-FRB | 6. L27V 55-169-FRB |
| 7. FKBP-L27V 84-169 | 7. FKBP-L27V 1-83 |
| 8. L27V 1-83-FRB | 8. L27V 84-169-FRB |
| 9. FKBP-L27V 103-169 | 9. FKBP-L27V 1-102 |
| 10. L27V 1-102-FRB | 10. L27V 103-169-FRB |
| 11. FKBP-L27V 157-169 | 11. FKBP-L27V 1-156 |
| 12. L27V 1-156-FRB | 12. L27V 157-169-FRB |

TABLE 21 pCA constructs

SEQ ID NO: 343 (pCA 31 pCA L27V02A 45-169 FRB)
SEQ ID NO: 344 (pCA 31 pCA L27V02A 45-169 FRB)
SEQ ID NO: 345 (pCA 32 FKBP L27V02A 1-44)
SEQ ID NO: 346 (pCA 32 FKBP L27V02A 1-44)
SEQ ID NO: 347 (pCA 33 pCA L27V02A 46-169 FRB)
SEQ ID NO: 348 (pCA 33 pCA L27V02A 46-169 FRB)
SEQ ID NO: 349 (pCA 34 pCA FKBP 1-45 L27V02A)
SEQ ID NO: 350 (pCA 34 pCA FKBP 1-45 L27V02A)
SEQ ID NO: 351 (pCA 35 pCA L27V02A 100-169 FRB)
SEQ ID NO: 352 (pCA 35 pCA L27V02A 100-169 FRB)
SEQ ID NO: 353 (pCA 36 FKBP L27V02A 1-99)
SEQ ID NO: 354 (pCA 36 FKBP L27V02A 1-99)
SEQ ID NO: 355 (pCA 37 L27V02A 101-169 FRB)
SEQ ID NO: 356 (pCA 37 L27V02A 101-169 FRB)
SEQ ID NO: 357 (pCA 38 FKBP 1-100 L27V02A)
SEQ ID NO: 358 (pCA 38 FKBP 1-100 L27V02A)
SEQ ID NO: 359 (pCA 39 L27V02A 102-169 FRB)
SEQ ID NO: 360 (pCA 39 L27V02A 102-169 FRB)
SEQ ID NO: 361 (pCA 40 FKBP L27V02A 1-101)
SEQ ID NO: 362 (pCA 40 FKBP L27V02A 1-101)
SEQ ID NO: 363 (pCA 41 L27V02A 143-169 FRB)
SEQ ID NO: 364 (pCA 41 L27V02A 143-169 FRB)
SEQ ID NO: 365 (pCA 42 FKBP 1-142 L27V02A)
SEQ ID NO: 366 (pCA 42 FKBP 1-142 L27V02A)
SEQ ID NO: 367 (pCA 43 L27V02A 145-169 FRB)
SEQ ID NO: 368 (pCA 43 L27V02A 145-169 FRB)
SEQ ID NO: 369 (pCA 44 FKBP 1-144 L27V02A)
SEQ ID NO: 370 (pCA 44 FKBP 1-144 L27V02A)
SEQ ID NO: 371 (pCA 45 L27V02A 147-169 FRB)
SEQ ID NO: 372 (pCA 45 L27V02A 147-169 FRB)

TABLE 21-continued pCA constructs

SEQ ID NO: 373 (pCA 46 FKBP-L27V02A 1-146)
SEQ ID NO: 374 (pCA 46 L27V02A-FKBP 1-146)
SEQ ID NO: 375 (pCA 47 L27V02A 148-169 FRB)
SEQ ID NO: 376 (pCA 47 L27V02A 148-169 FRB)
SEQ ID NO: 377 (pCA 48 FKBP-L27V02A 1-147)
SEQ ID NO: 378 (pCA 48 FKBP-L27V02A 1-147)
SEQ ID NO: 379 (pCA 49 L27V02A 156-169 FRB)
SEQ ID NO: 380 (pCA 49 L27V02A 156-169 FRB)
SEQ ID NO: 381 (pCA 50 FKBP-L27V02A 1-155)
SEQ ID NO: 382 (pCA 50 FKBP-L27V02A 1-155)
SEQ ID NO: 383 (pCA 51 L27V02A 158-169 FRB)
SEQ ID NO: 384 (pCA 51 L27V02A 158-169 FRB)
SEQ ID NO: 385 (pCA 52 FKBP 1-157 L27V02A)
SEQ ID NO: 386 (pCA 52 FKBP 1-157 L27V02A)
SEQ ID NO: 387 (pCA 53 L27V02A 166-169 FRB)
SEQ ID NO: 388 (pCA 53 L27V02A 166-169 FRB)
SEQ ID NO: 389 (pCA 54 FKBP L27V02A 1-165)
SEQ ID NO: 390 (pCA 54 FKBP L27V02A 1-165)
SEQ ID NO: 391 (pCA 55 FKBP L27V02A 1-47)
SEQ ID NO: 392 (pCA 55 FKBP L27V02A 1-47)
SEQ ID NO: 393 (pCA 56 L27V02A 48-169-FRB)
SEQ ID NO: 394 (pCA 56 L27V02A 48-169-FRB)
SEQ ID NO: 395 (pCA 57 FKBP L27V02A 1-49)
SEQ ID NO: 396 (pCA 57 FKBP L27V02A 1-49)
SEQ ID NO: 397 (pCA 58 pCA L27V02A 50-169 FRB)
SEQ ID NO: 398 (pCA 58 pCA L27V02A 50-169 FRB)
SEQ ID NO: 399 (pCA 59 FKBP L27V02A 1-82)
SEQ ID NO: 400 (pCA 59 FKBP L27V02A 1-82)
SEQ ID NO: 401 (pCA 60 L27V02A 83-169-FRB)
SEQ ID NO: 402 (pCA 60 L27V02A 83-16-FRB)
SEQ ID NO: 403 (pCA 61 FKBP L27V02A 1-84)
SEQ ID NO: 404 (pCA 61 FKBP L27V02A 1-84)
SEQ ID NO: 405 (pCA 62 L27V02A 85-169-FRB)
SEQ ID NO: 406 (pCA 62 L27V02A 85-169-FRB)
SEQ ID NO: 407 (pCA 63 FKBP L27V02A 1-122)
SEQ ID NO: 408 (pCA 63 FKBP L27V02A 1-122)
SEQ ID NO: 409 (pCA 64 L27V02A 123-169-FRB)
SEQ ID NO: 410 (pCA 64 L27V02A 123-169-FRB)
SEQ ID NO: 411 (pCA 65 FKBP L27V02A 1-123)
SEQ ID NO: 412 (pCA 65 FKBP L27V02A 1-123)
SEQ ID NO: 413 (pCA 66 L27V02A 124-169 FRB)
SEQ ID NO: 414 (pCA 66 L27V02A 124-169 FRB)
SEQ ID NO: 415 (pCA 67 L27V02A 1-168)
SEQ ID NO: 416 (pCA 67 L27V02A 1-168)
SEQ ID NO: 417 (pCA 67 L27V02A 1-168)
SEQ ID NO: 418 (*pCA 68 L27V02A 169 FRB)
SEQ ID NO: 419 (*pCA 68 L27V02A 169 FRB)
SEQ ID NO: 420 (pCA 69 FKBP L27V02A 1-166)
SEQ ID NO: 421 (pCA 69 FKBP L27V02A 1-166)
SEQ ID NO: 422 (*pCA 70 L27V02A 167-169 FRB)
SEQ ID NO: 423 (*pCA 70 L27V02A 167-169 FRB)
SEQ ID NO: 424 (pCA 71 FKBP L27V02A 1-164)
SEQ ID NO: 425 (pCA 71 FKBP L27V02A 1-164)
SEQ ID NO: 426 (pCA 72 L27V02A 165-169 FRB)
SEQ ID NO: 428 (pCA 72 L27V02A 165-169 FRB)
SEQ ID NO: 429 (pCA 73 FKBP L27V02A 1-162)
SEQ ID NO: 430 (pCA 73 FKBP L27V02A 1-162)
SEQ ID NO: 431 (pCA 74 L27V02A 163-169 FRB)
SEQ ID NO: 432 (pCA 74 L27V02A 163-169 FRB)
SEQ ID NO: 433 (pCA 75 FKBP L27V02A 1-160)
SEQ ID NO: 434 (pCA 75 FKBP L27V02A 1-160)
SEQ ID NO: 435 (pCA 76 L27V02A 161-169 FRB)
SEQ ID NO: 436 (pCA 76 L27V02A 161-169 FRB)
SEQ ID NO: 437 (pCA 77 FKBP L27V02A 1-158)
SEQ ID NO: 438 (pCA 77 FKBP L27V02A 1-158)
SEQ ID NO: 439 (pCA 78 L27V02A 159-169 FRB)
SEQ ID NO: 440 (pCA 78 L27V02A 159-169 FRB)

The complementation pairs described in Table 42 were cloned into the pF4Ag vector as previously described. The PCA constructs (900 µL) were then expressed in rabbit reticulocyte lysate (RRL; Promega Corp.) or wheat germ extract (Promega Corp.) following the manufacture's instructions. 1.25 µL of the expression reactions for each PCA pair were mixed with 10 µL of 2× Binding Buffer (100 mM HEPES, 200 mM NaCl, 0.2% CHAPS, 2 mM EDTA, 20% glycerol, 20 mM DTT, pH 7.5) and 7.5 µL water, and 18 µL transferred to wells of a 96-well plate. 2 µL of 5 µM Rapamycin (final concentration 0.5 µM) was added and incubated for 10 min at room temperature.

Figure 76:
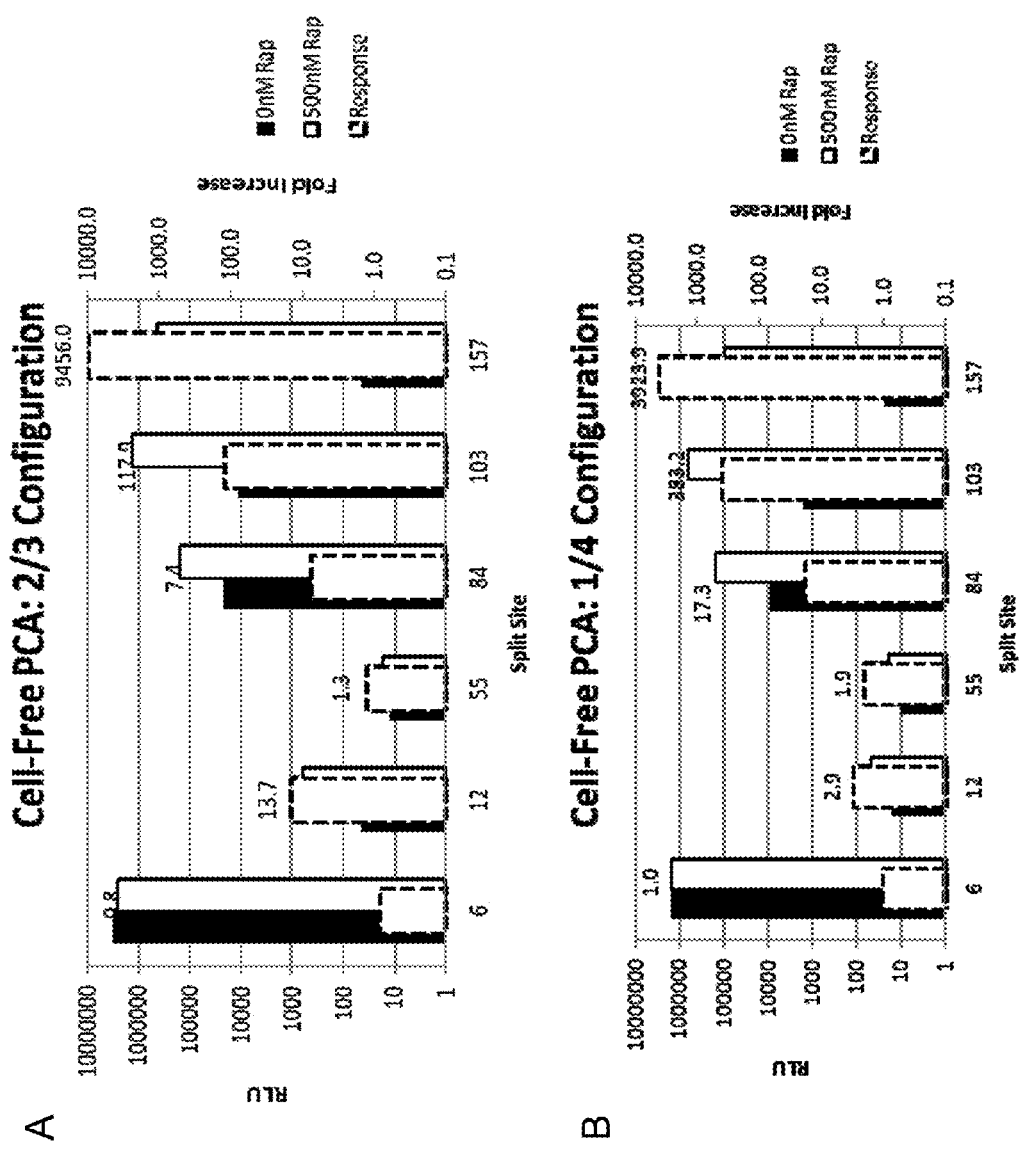
FIGS. 76A-H show the luminescence of various protein complementation (PCA) L27V pairs: one L27V fragment of each pair was fused to either FKBP or FRB using a ⅔ configuration (FIGS. 76A and 76C) or a ¼ configuration (FIGS. 76B and 76D), and the interaction of FKBP and FRB monitored in wheat germ extract (FIGS. 76A and 76B) and rabbit reticulocyte lysate (RRL) (FIGS. 76C and 76D). The luminescence of various protein complementation (PCA) negative controls was also measured (FIG. 76E) in cell free system. The ¼ configuration was used in a cell free system (FIG. 76F), HEK293 cells (FIG. 76G) and in a lytic system (FIG. 76H).
Figure 76:
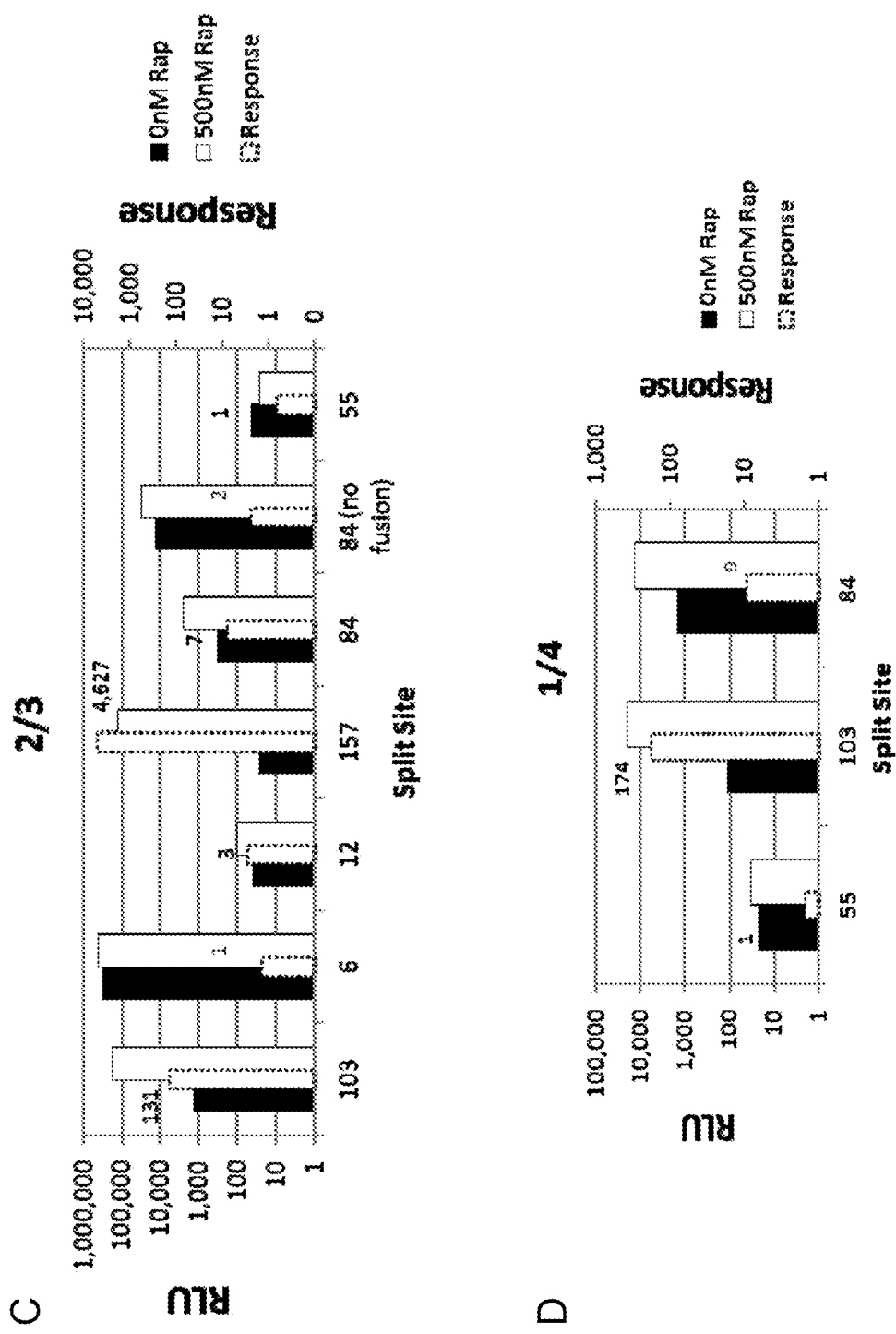
Figure 76E:
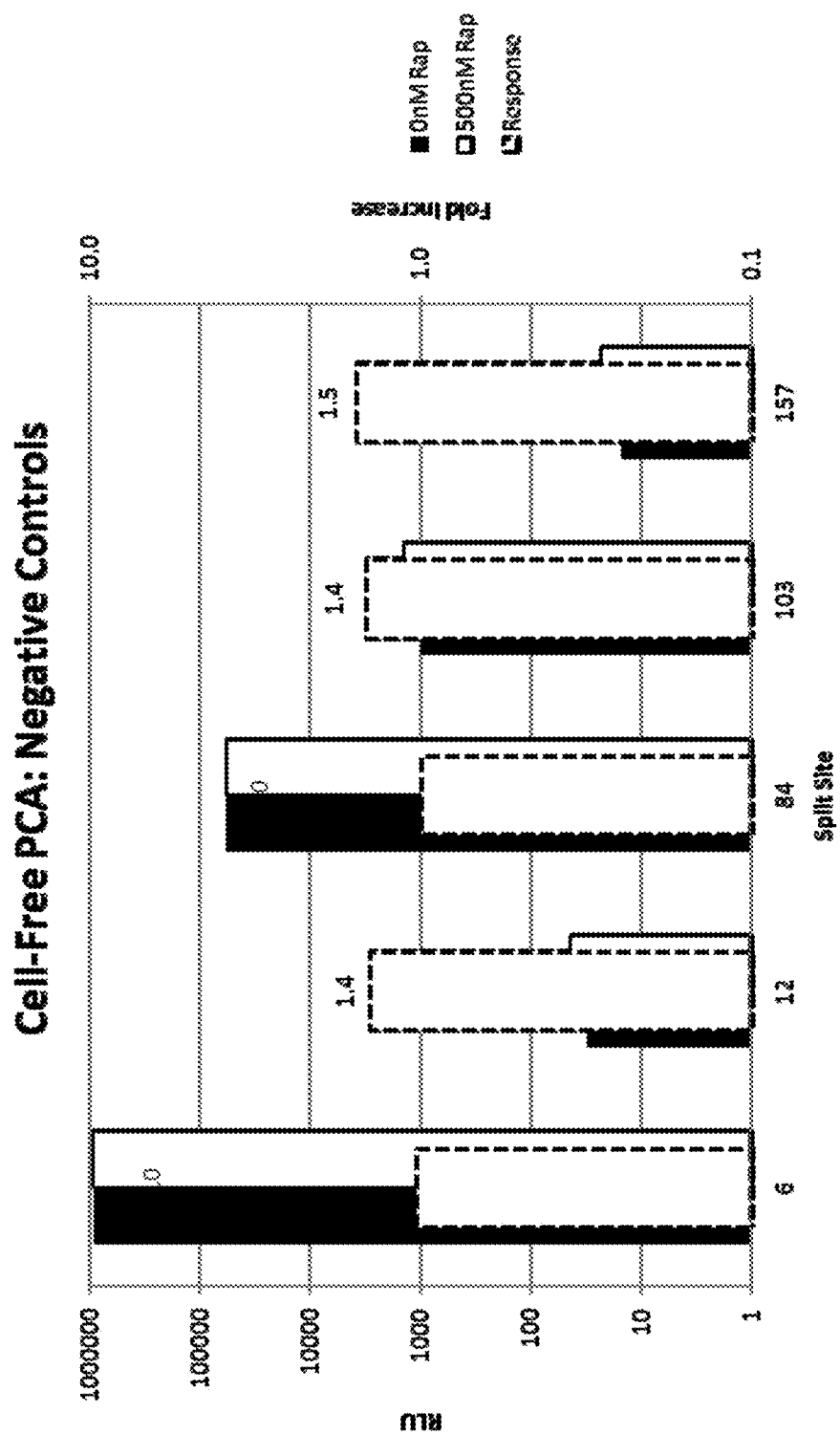
Figure 76F:
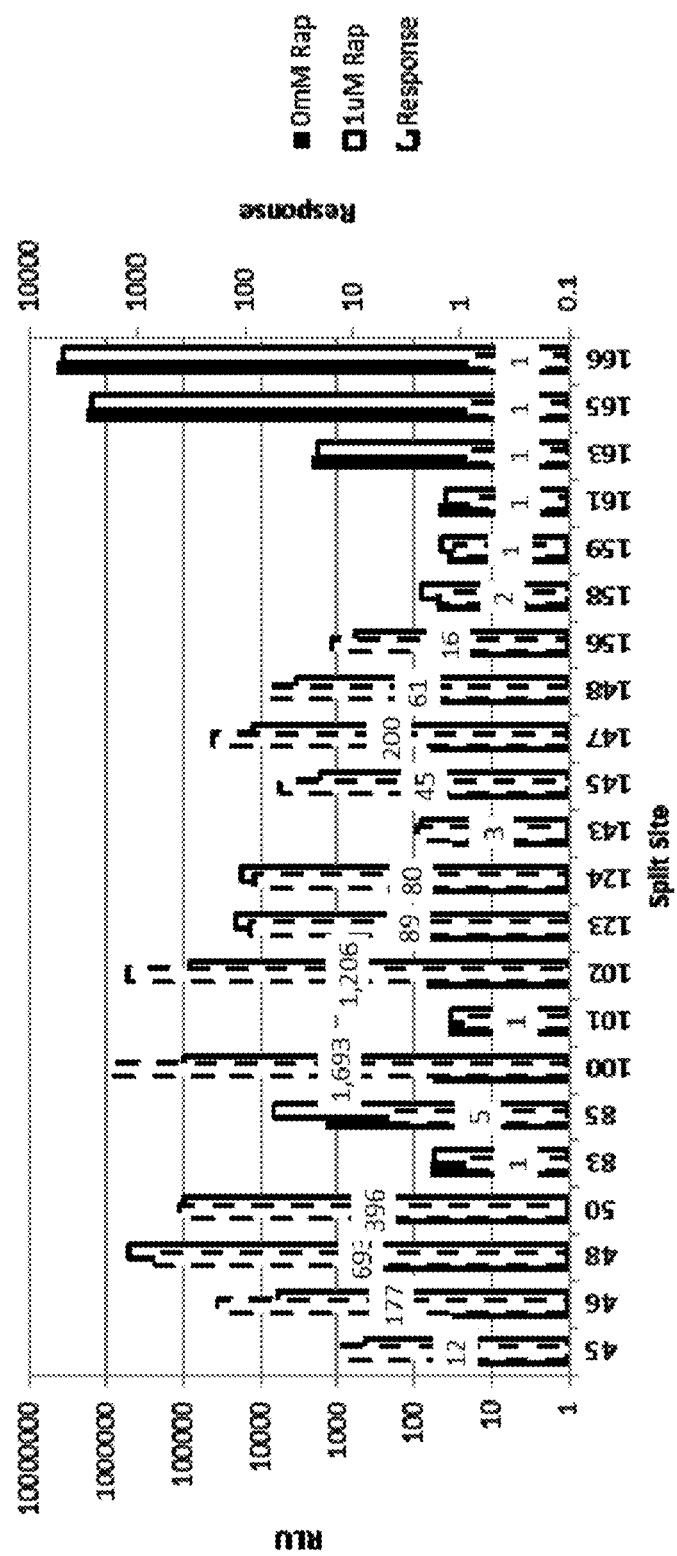
Figure 76G:
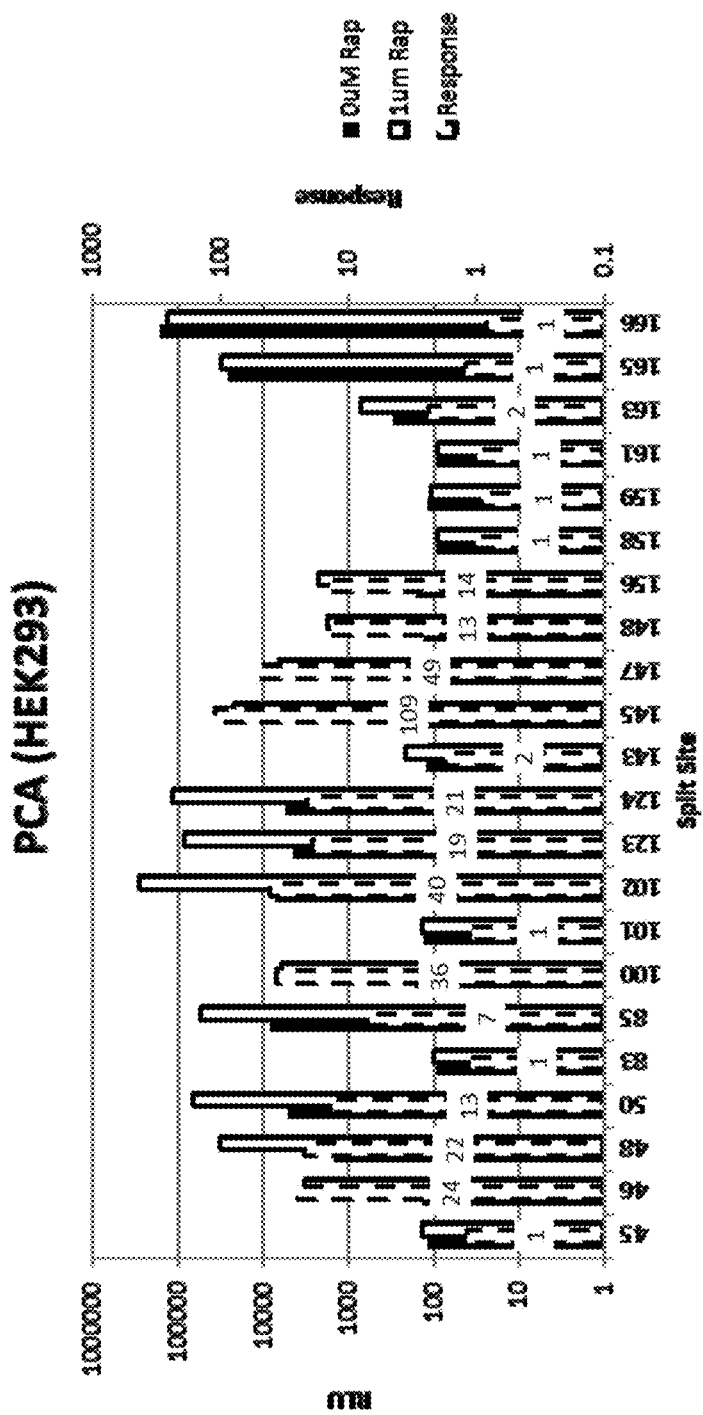

Following incubation, 100 µL of PBI-3939 (50× stock diluted to 1× in assay buffer) and incubate for 3 min at room temperature. Luminescence was measured as previously described (FIG. 76A-B: wheat germ; FIG. 76C-D: rabbit reticulocyte; FIG. 76E-F: cell free system [which system? WG or RRL?]; FIG. 76G: HEK293 cells).

FIG. 76A-G show the luminescence of various protein complementation (PCA) L27V pairs: one L27V fragment of each pair was fused to either FKBP or FRB using a ⅔ configuration (FIGS. 76A and 76C) or a ¼ configuration (FIGS. 76B and 76D) as described, and the interaction of FKBP and FRB monitored in wheat germ extract (FIGS. 76A and 76B) and rabbit reticulocyte lysate (RRL) (FIGS. 76C and 76D); and the luminescence of various protein complementation (PCA) negative controls (FIG. 76E). The luminescence of various protein complementation L27V using a ¼ configuration in a cell free system (RRL) (FIG. 76F) and HEK293 cells (FIG. 76G) was measured. The data in FIGS. 76A-G demonstrates that a variety of different deletions, i.e., small fragments of the L27V variant, are functional.

3. To demonstrate the use of the PCA constructs for cell-based PCA, the constructs were transfected into HEK293 cells and assayed with PBI-4377. Plasmid DNA (5 ng) from each PCA pair (6, 12, 55, 84, and 103) were mixed with 40 ng carrier DNA (pGEM-3fz) and 5 µL OPTI-MEM® and incubated at room temperature for 5 min. FUGENE® HD (0.15 µL) was then added and again incubated at room temperature for 15 min. The DNA transfection mixtures were added to 100 µL HEK293 cells ($1.5 \times 10^5$ cells/mL) in DMEM with 10% FBS (no antibiotics), transferred to wells of a 96-well plate, and incubated overnight at 37° C., 5% $CO_2$ After transfection, the media was removed and replaced with $CO_2$-independent media with 20 µM or 50×PBI-4377 and incubated at 37° C. without $CO_2$ regulation for 2 hrs. Luminescence was measured, 10 µL rapamycin added, and luminescence measured again every 2 min for 2 hrs (FIGS. 76A-C).

4. To demonstrate the use of the PCA constructs to identify inhibitors of protein-protein interactions, the constructs described in #2 of this example were used.

Figure 77:
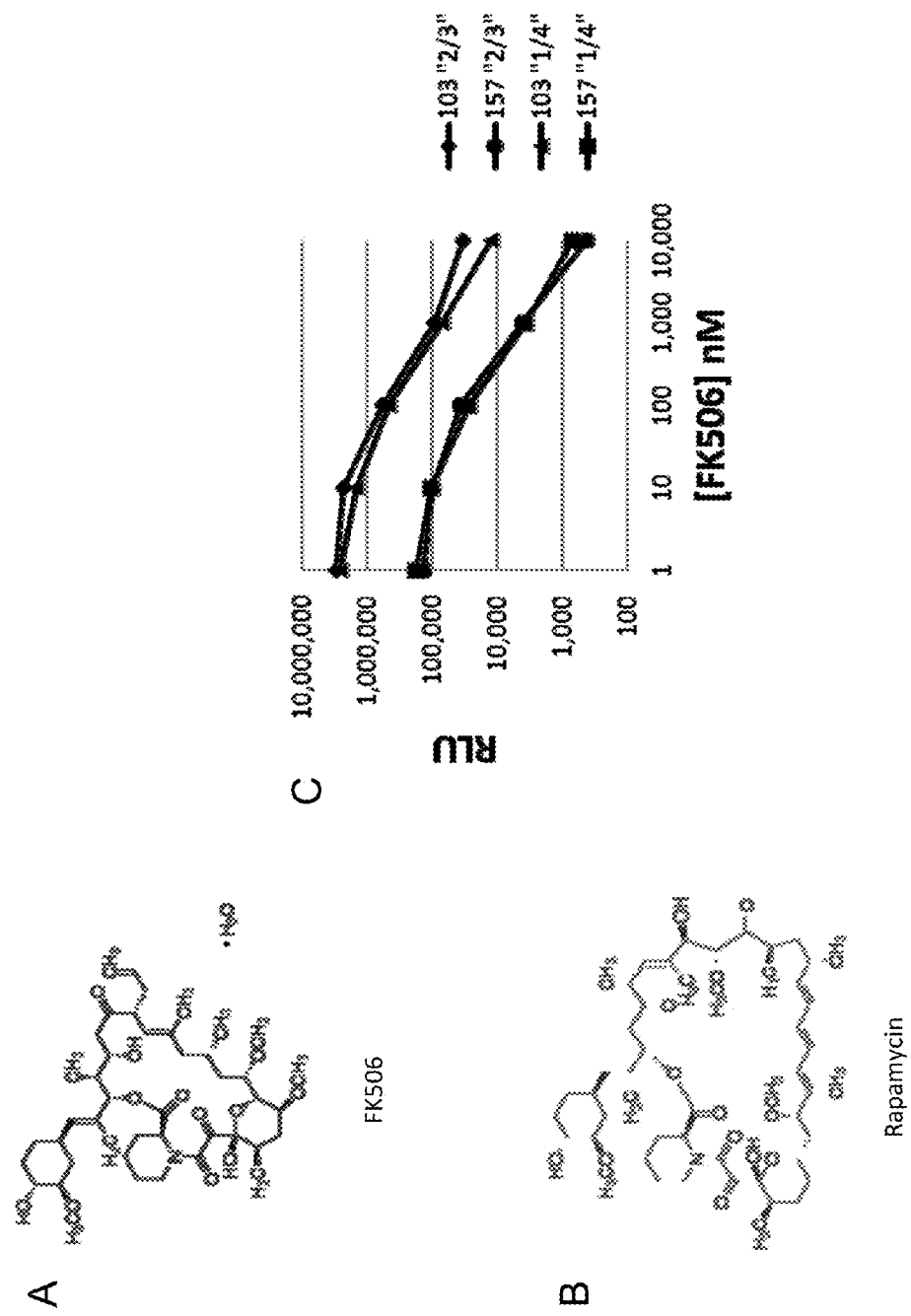
FIGS. 77A-C show the luminescence of various protein complementation L27V pairs treated with FK506 and rapamycin (FIG. 77A) and the chemical structure of FK506 (FIG. 77A) and rapamycin (FIG. 77B).

The complementation pairs, 103 "⅔", 157 "⅔", 103 "¼" and 157 "¼" described in Table 42 were cloned into the pF4Ag vector as previously described. The PCA constructs (25 µL) were then expressed in rabbit reticulocyte lysate (RRL; Promega Corp.) following the manufacture's instructions. 1.25 µL of the expression reactions for each PCA pair were mixed with 10 µL of 2× Binding Buffer (100 mM HEPES, 200 mM NaCl, 0.2% CHAPS, 2 mM EDTA, 20% glycerol, 20 mM DTT, pH 7.5) and 7.5 µL water, and 16.2 µL transferred to wells of a 96-well plate. Rapamycin was examined with various amounts of FK506. To the reactions, the FRB-FKBP binding inhibitor, FK506 (10×) was added, and the reactions incubated at room temperature for 10 min. 15 nM rapamycin (10× stock solution) was added to get a final concentration of 1.5 nM rapamycin and incubated for 2 hrs at room temperature. Following incubation, 100 µL of PBI-3939 (50× stock diluted to 1× in assay buffer) and incubated for 3 min at room temperature. Luminescence was measured on a GLOMAX® luminometer. FIG. 77 demonstrates that the PCA constructs disclosed herein can be used to identify inhibitors of protein-protein interactions.

5. To demonstrate the use of the PCA constructs in a lytic format, the complementation pairs, 103 "⅔", 157 "⅔", and 103 "¼" were transfected into HEK293 cells and assayed with PBI-3939. 0.5 ng plasmid from each PCA pair was mixed with 5 μL OPTI-MEM® and 49 ng pGEM-3zf (Promega Corp.). The sample mixture was incubated at room temperature for 5 min. 0.15 μL FUGENE® HD was then added to the sample mixture and incubated at room temperature for 15 min. 100 μL of HEK293 cells in DMEM with 10% FBS (no antibiotics) at a concentration of 1.5×10⁵ cells/mL was added to each sample mixture. The cell sample was then transferred to a well of a 96-well plate and incubated at 37° C., 5% $CO_2$ overnight.

Figure 76H:
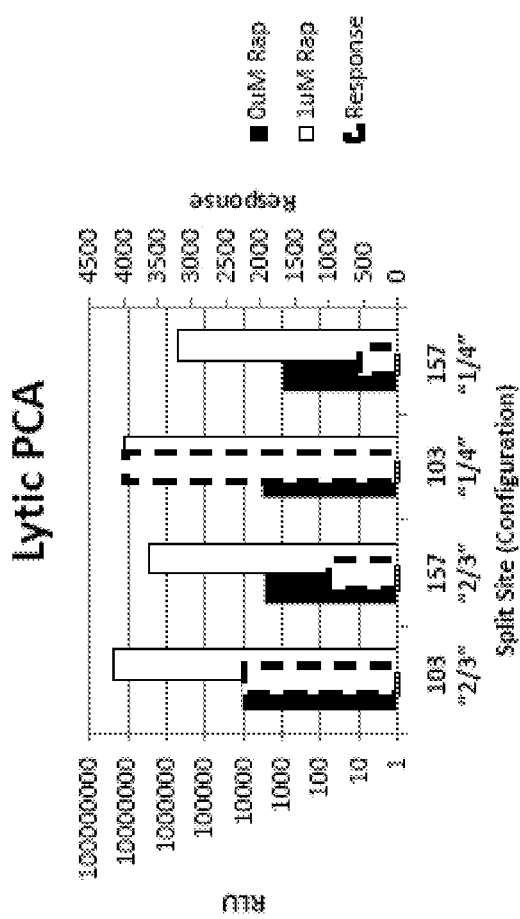

The next day, 11.1 μL of 10 μM Rapamycin (Final concentration 1 μM) was added to half of the wells and 11.1 μL water was added to other half of the wells. The 96-well plates were incubated at 37° C. for 1 hr. 100 μL of assay reagent+PBI-3939 (2 μL 50×PBI-3939 mixed with 98 μL assay reagent, previously described) was added to each well and the plates were incubated at 37° C. for 4 min. Luminescence was measured on a GLOMAX® luminometer at 37° C. with 0.5 s integration time and 1 read. (FIG. 76H).

Example 50—OgLuc cAMP Biosensor

The OgLuc variants of the present invention can be linked to light output not only through concentration, but also through modulation of enzymatic activity. For example, a cAMP biosensor can be developed by incorporating a cAMP-binding domain from Protein Kinase A into a circularly permuted OgLuc variant. An OgLuc variant of the present invention can be circularly permuted at a site(s) tolerable to such permutation by methods known in the art (e.g., U.S. Published Application No. 2005/0153310). The resulting circularly permuted OgLuc variant chimeric protein can function as an intracellular biosensor for cAMP when expressed in mammalian cells. Upon binding of cAMP to the biosensor, the biosensor undergoes a conformational change that creates an active luciferase enzyme. Treating the cells with forskolin, an activator for adenylate cyclase, should result in an increase in luminescence with increasing concentrations of forskolin. Similar biosensors for targets including but not limited to calcium (Ca+2), cGMP, and proteases such as caspases and tobacco etch virus (TEV) can be developed by incorporating the appropriate binding domain or cleavage site for each into a circularly permuted OgLuc variant.

The utility of OgLuc as a biosensor was demonstrated by analysis of variant 9B8 opt in the context of a cAMP sensor. Circularly permuted constructs containing the RIIβB subunit of Protein Kinase-A flanked by OgLuc variant sequences were made and expressed in a cell free system as described in described in PCT application PCT/US2007/008176, except the sites for circular permutation were chosen as described below. The nascent protein was assayed in the presence and absence of cAMP. Response to cAMP is defined as the ratio of activity (+) cAMP/(−) cAMP.

A structural model for OgLuc has been created, based on similarities to certain fatty acid binding proteins of known structure, previously described in PCT/US2010/33449. The model predicts an ordered sequence of the standard protein structural motifs; α-helix and β-sheet. The regions that transition between these structural elements as circular permutation sites were chosen (see Table 43).

1. The template for expression of the biosensor constructs consisted of: C-terminal OgLuc sequence-RIIβB sequence-N-terminal OgLuc sequence in plasmid pF5 (Promega Corp.). The TNT® T7 Coupled Wheat Germ Extract System (Promega Part #L4140) was used to translate the construct. The TNT® Wheat Germ Extract Reaction included 25 μL TNT® Wheat Germ Extract (L411A), 2 μL TNT® Reaction Buffer (L462A), 1 μL Amino Acid Mixture, Complete (L446A), 1 μL RNasin® (40 U/μL) (N2615), 1 μL TNT® T7 RNA Polymerase (L516A), 1.0 μg DNA template and Nuclease-Free Water to bring the total volume to 50 μL. The reaction mixture was incubated at 30° C. for 120 min.

An OgLuc activity assay was performed by adding to the 50 μL OgLuc translation mixture, 50 μL OgLuc Glo Reagent (100 mM MES (pH 6.0), 1 mM CDTA, 150 mM KCl, 35 mM thiourea, 2 mM DTT, 0.25% TERGITOL® NP-9 (v/v), 0.025% MAZU® DF 204, and 20 μM PBI-3939) with or without 100 μM cAMP, and performing a kinetic read for 30 min (TECAN® INFINITE® F500 Plate Reader). Response is determined by dividing the luminescence generated by the biosensor with cAMP by the luminescence generated by the biosensor without cAMP (Table 43).

TABLE 43

Response of Circularly-Permuted OgLuc Biosensors to cAMP

| CP-SITE | RESPONSE |
|---------|----------|
| 27 | 2.6X |
| 51 | 2.2X |
| 84 | 1.5X |
| 122 | 4.3X |
| 147 | 1.9X |
| 157 | 5.6X |

Figure 78:
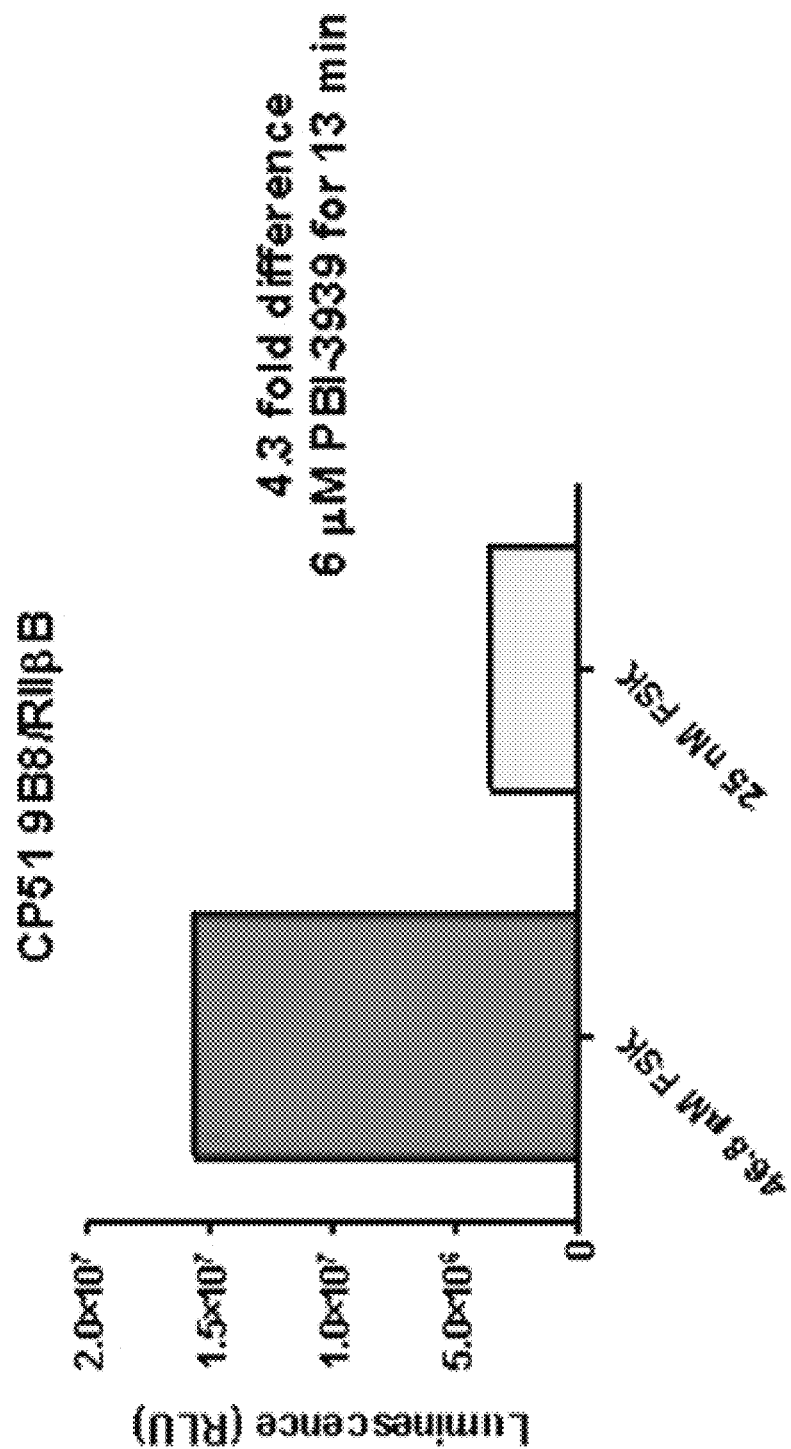
FIG. 78 shows the activity of the OgLuc variant 9B8 cAMP biosensor with forskolin treatment.

2. A cAMP biosensor of 9B8opt circularly permuted at the CP-site 51 was created as described in 1. The biosensor was then transfected into HEK293 cells (15,000 cells/well) using FUGENE® HD according to the manufacturer's instructions into a 96-well plate, and incubated overnight at 37° C., 5% $CO_2$. After transfection, the media was removed and replaced with $CO_2$-independent media with 10% FBS. The cells were then incubated for 2 hrs at 37° C., 5% $CO_2$ after which varying amounts of FSK were added. The cells were then again incubated for 3 hrs at 37° C., 5% $CO_2$. 6 μM PBI-3939 was then added, and luminescence measured after 13 min (FIG. 78).

Figure 79:
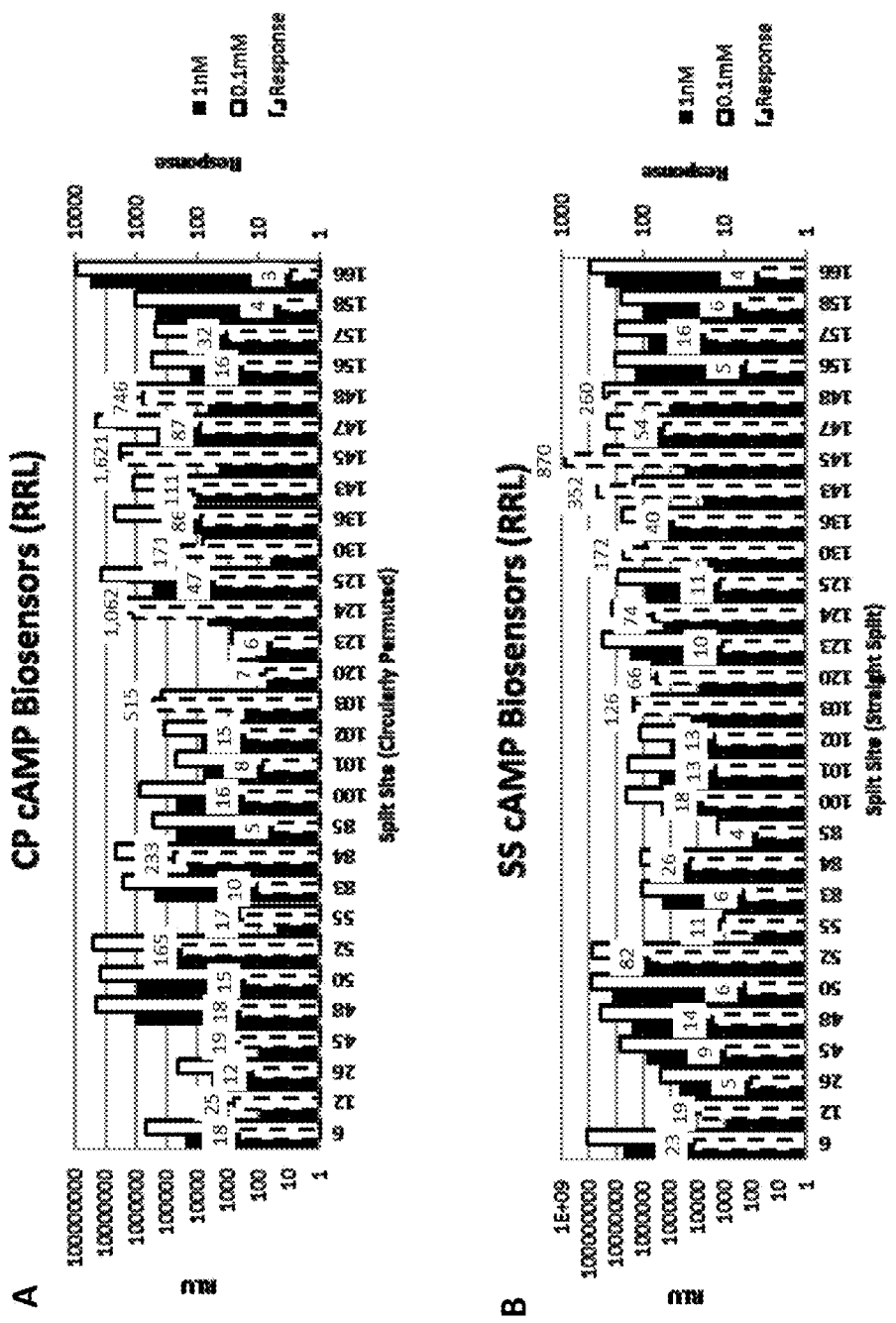
FIGS. 79A-D show the luminescence of circularly permuted (FIGS. 79A and 79C) and straight split (FIGS. 79B and 79D) L27V variants in rabbit reticulocyte lysate (FIGS. 79A-B) and HEK293 cells (FIGS. 79C-D).
Figure 79:
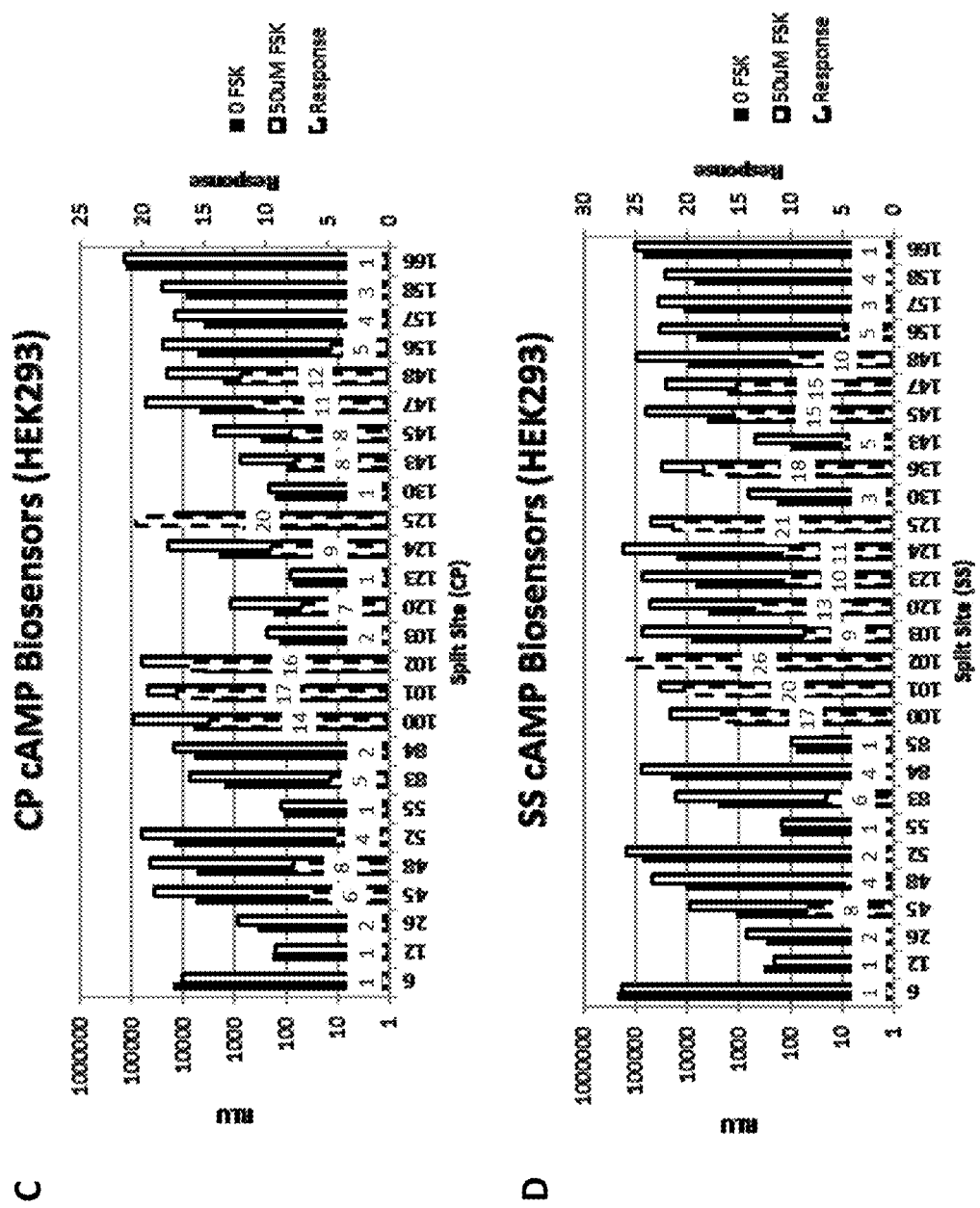

3. Circularly permuted ("CP"; e.g., CP6 refers to the old residue 6 being new residue 1 after Met) and Straight Split ("SS"; e.g., SS6 refers to a sensor orientated as follows: OgLuc (1-6)-RIIβB binding site (SEQ ID NOs: 441 and 442)-OgLuc (7-169)) versions of L27V were used as cAMP biosensors (SEQ ID NOs: 467-574). CP (SEQ ID NOs: 467-498 and 555-574) and SS (SEQ ID NOs: 499-554) versions of the L27V variant were derived as previously described and expressed in expressed in rabbit reticulocyte lysate (RRL; Promega Corp.) following the manufacture's instructions. The linker sequence between the C-terminus of the RIIβB binding site and OgLuc luciferase sequence was GGGTCAGGTGGATCTGGAGGTAGCTCTTCT (SEQ ID NO: 575). The linker sequence between the N-terminus of the RIIβB binding site and OgLuc luciferase sequence was AGCTCAAGCGGAGGTTCAGGCGGTTCCGGA (SEQ ID NO: 576) 3.75 μL of the expression reactions were mixed with 1.25 μL 4× cAMP (final concentration 1 nM-0.1 mM), and incubated at room temperature for 15 min. Following incubation, 100 μL of PBI-3939 (50× stock diluted to 1× in assay buffer) and incubated for 3 min at room temperature. Luminescence was measured on a GLOMAX® luminometer (FIGS. 79A-B). Luminescence was also measured for CP and SS versions of the L27V variant expressed in HEK293 cells and treated with forskolin as previously described (FIGS. 79C-D). FIGS. 79A-D demonstrates that circularly permuted and straight split versions of the OgLuc variants disclosed herein can be used as biosensors.

Example 51—Subcellular Distribution and Localization

Figure 80:
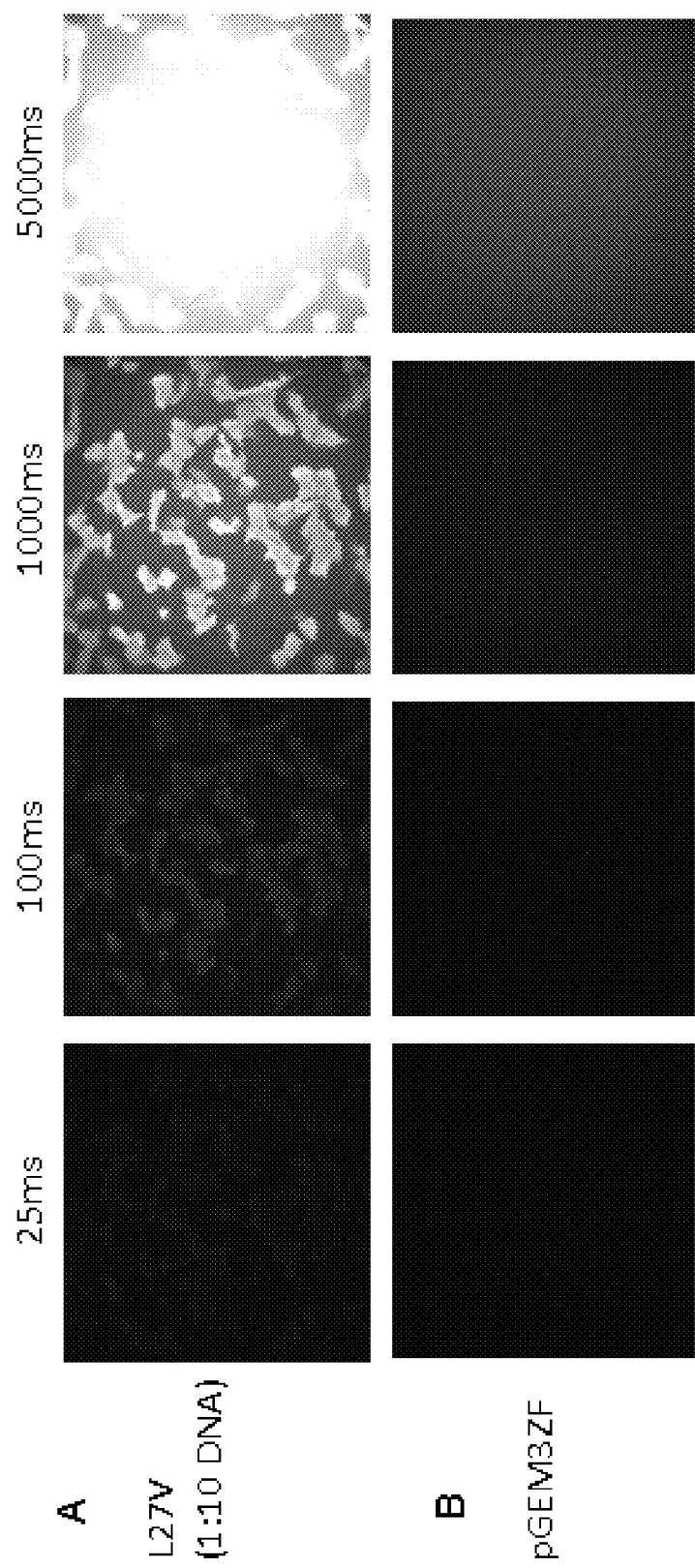
FIGS. 80A-B show the subcellular distribution of the OgLuc variant L27V (FIG. 80A) and control vector pGEM3ZF (FIG. 80B) in U2OS cells for various exposure times.

To analysis subcellular distribution, U2OS cells were plated at $2 \times 10^4$ cells/cm$^2$ into glass-bottom culture dishes in McCoy's 5A media (Invitrogen) containing 10% FBS. The cells were then incubated for 24 hrs at 37° C., 5% $CO_2$. Cells were then transfected with 1/20 volume transfection mixture (FUGENE® HD and pF5A-CMV-L27V (the L27V variant (SEQ ID NO: 88) cloned into the pF5A vector with CMV promoter (Promega Corp.)) or pGEM3ZF (Promega Corp.; negative control)) and incubated for 24 hrs at 37° C., 5% $CO_2$. Following incubation, the cell media was replaced with $CO_2$-independent media with 0.5% FBS and 100 µM PBI-4378. After a 30 min incubation at 37° C., unfiltered images were captured on an Olympus LV200 bioluminescence microscope using a 60× objective (FIGS. 80A-B) for 25, 100, 1000, and 5000 ms.

Figure 81:
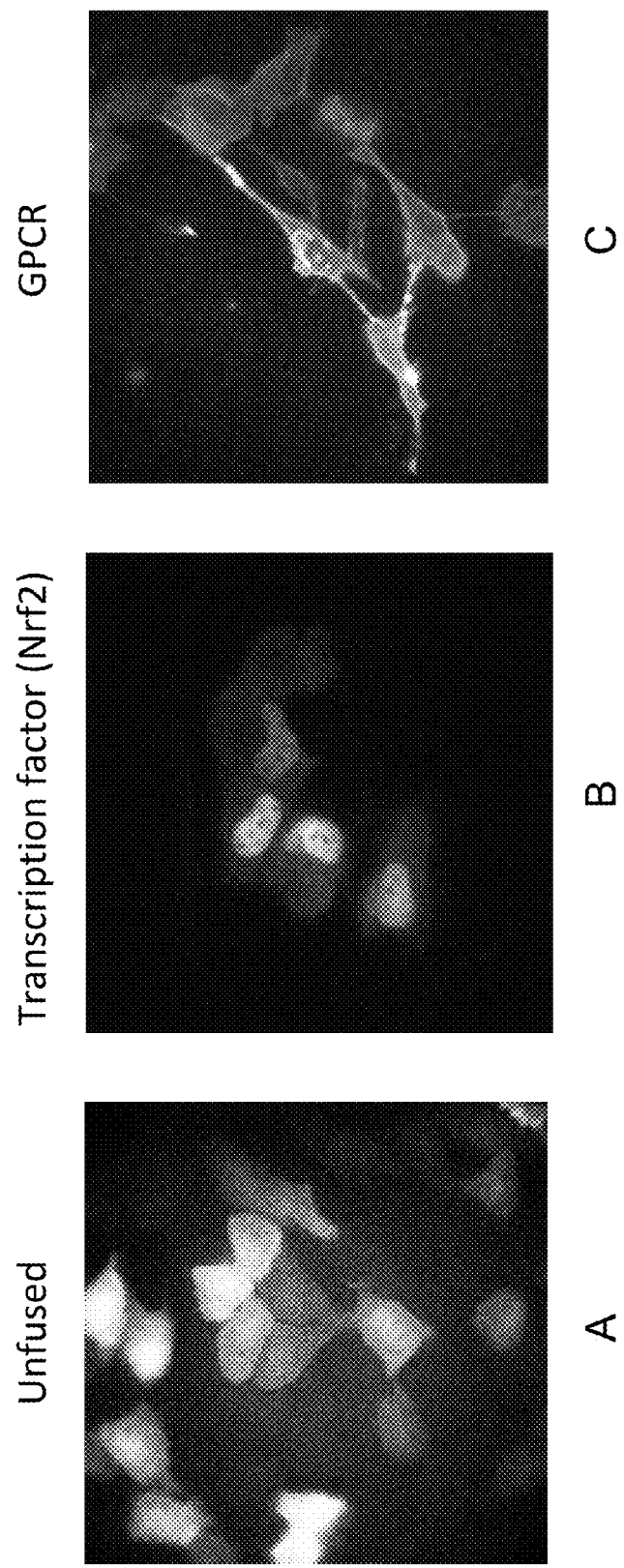
FIGS. 81A-C show the subcellular location of the OgLuc variant L27V fused to either the transcription factor Nrf2 (FIG. 81B) or GPCR (FIG. 81C) compared to an unfused L27V control (FIG. 81A).

To analyze subcellular localization, N-terminal L27V fusions with the GPCR AT1R (Angiotensin type 1 receptor (SEQ ID NOs: 459 and 460)) with IL-6 secretion sequence (SEQ ID NOs: 461 and 462) or the transcription factor, Nrf2 (SEQ ID NO: 317), were made using a GSSG linker (SEQ ID NOs: 457 and 458) and transfected into U2OS cells as described above (FIGS. 81A-C). FIG. 81C ("GPRC") shows expression of a construct where the IL6 signal sequence is upstream of the L27V variant sequence and the AT1R is downstream of the L27V variant sequence. The L27V variant alone was also transfected ("Unfused"). After a 24 hr incubation at 37° C., 5% $CO_2$, cell media was replaced with $CO_2$-independent media with 0.5% FBS and equilibrated for 1 hr at 37° C. in a non-$CO_2$-regulated atmosphere. An equal volume of media+200 µM PBI-3939 was then added, and unfiltered images were captured immediately on an Olympus LV200 bioluminescence microscope using a 60× or 150× objective (FIGS. 81A-C). For cells expressing L27V alone, PBI-3939 was washed off the cells immediately before image capture.

Example 52—Monitoring Intracellular Signal Pathways

This example provides two examples of the novel luciferase being used to monitor intracellular signal pathways at the protein level (as opposed to the response element examples which represent transcriptional activation). The variant 9B8opt (SEQ ID NO: 24) was fused to either IkB (Gross et al., *Nature Methods* 2(8):607-614 (2005)) (at the C-terminus, i.e., N-IkB-(9B8opt)-C)) or ODD(oxygen-dependent degradation domain of Hif-1-α (Moroz et al., *PLoS One* 4(4):e5077 (2009)) (at the N-terminus, i.e., N-(9B8opt)-ODD-C)). IKB is known to be degraded in cells upon stimulation with TNFα; therefore, the IKB-(9B8opt) construct could be used as a live cell TNFα sensor. ODD (Hif-1-α) is known to accumulate inside cells upon stimulation with compounds that induce hypoxia; therefore, the ODD-(9B8opt) construct could be used as a live cell hypoxia sensor.

Constructs containing fusions with IkB or ODD with 9B8opt (pF5A) were expressed in HEK293 cells via reverse transfection (5 ng (IkB) or 0.05 ng (ODD) DNA (mixed with carrier DNA to give a total of 50 ng)) as previously described and incubated for 24 hrs at 37° C., 5% $CO_2$. After transfection, the media was replaced with fresh $CO_2$-independent media containing 0.5% FBS and 20 µM PBI-4377 and allowed to equilibrate for 4 hrs at 37° C., atmospheric $CO_2$. Cells were then exposed to a stimulus: TNFα for IkB fusion expressing cells and phenanthroline for ODD fusion expressing cells. DMSO (vehicle) was added to control cells. For the TNFα/IKB samples, 100 µg/mL cycloheximide was added approximately 15 min prior to adding the stimulus to prevent synthesis of new protein. At the indicated time points following treatment, cells were assayed for luminescence. For data normalization, the RLU of each sample at a given time point were divided by the RLU from the same sample immediately after stimulation. Fold response for each sensor was then determined (FIGS. 82A-C).

B. L27V was used to monitor the oxidative stress signal pathways at the protein level. L27V or *Renilla* luciferase (Rluc) was fused to Nrf2/NFE2L2 in a pFSK expression vector (at the C-terminus; i.e., N-Nrf2-(L27V)-C or N-Nrf2-(Rluc)-C). Keap1 is a negative regulator of Nrf2 (SEQ ID NO: 217). In order to faithfully represent regulation of Nrf2-L27V02 protein levels, Keap1, was co-expressed to keep Nrf2 levels low (via ubiquitination).

Figure 83:
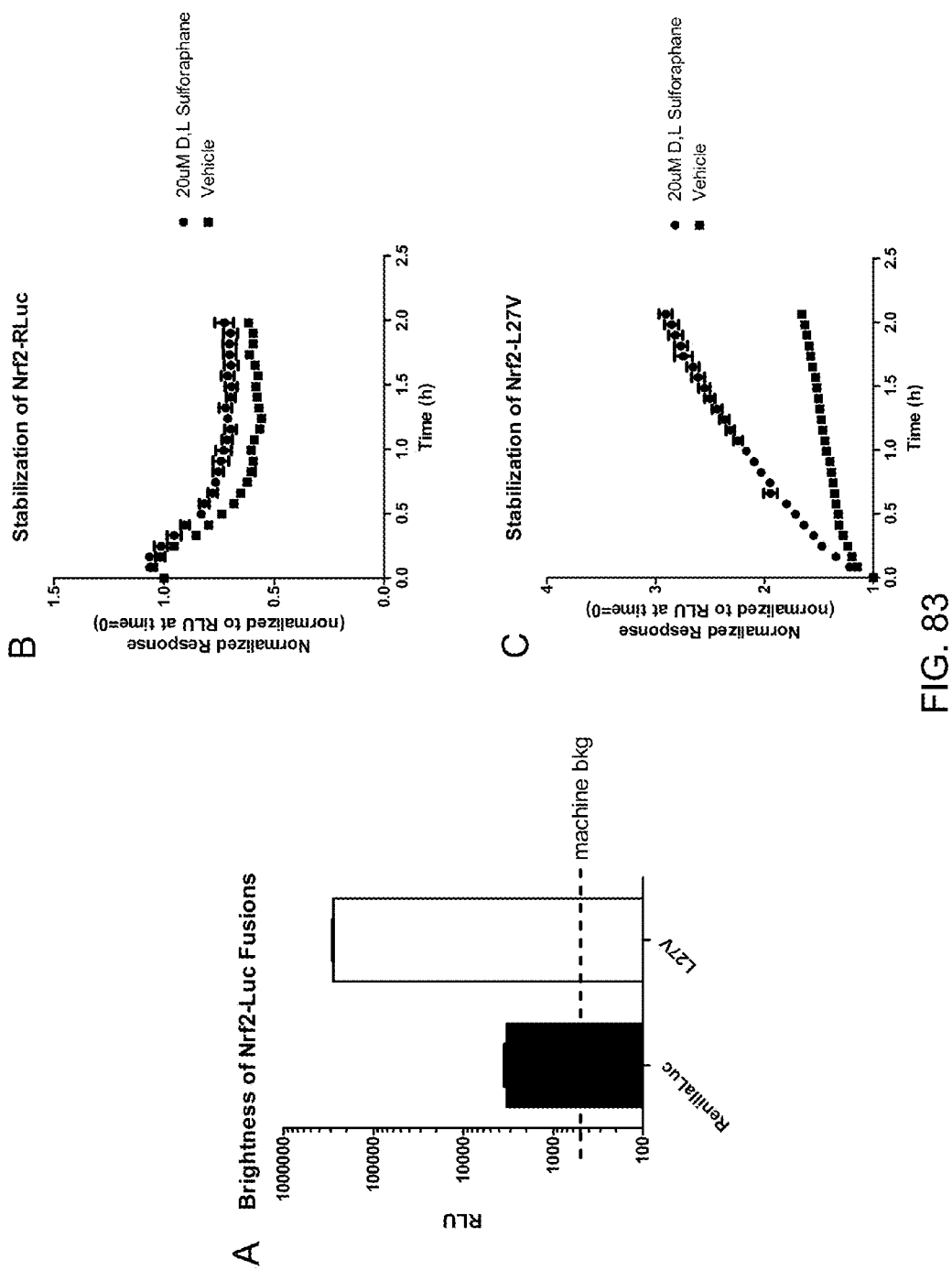
FIGS. 83A-C show the monitoring of oxidative stress signal pathways using the OgLuc variant (FIG. 83A), L27V02 (FIG. 83B), or *Renilla* luciferase (Rluc) (FIG. 83C).

Nrf2-L27V or Nrf2-Rluc (5 ng, pFSK) and a HALOTAG®—Keap1 fusion protein (pFN21-HT7-Keap1 (SEQ ID NO: 316); 50 ng) were expressed in HEK293 cells by transfection of the cells at the time of seeding into the 96-well plates as previously described and incubated for 24 hrs at 37° C., 5% $CO_2$. After transfection, the media was replaced with fresh $CO_2$-independent media with 0.5% FBS and 20 µM PBI-4377 for L27V or 20 µM ENDUREN™ (Promega Corp.) for *Renilla* luciferase, and the cells equilibrated for 4 hrs at 37° C. under atmospheric $CO_2$. For kinetic analysis, 20 µM D,L sulforaphane or vehicle (DMSO) were used. In FIG. 83A, luminescence was measured as previously described at the indicated time points following treatment. For data normalization, the luminescence of each sample at a given time point was divided by the luminescence from the same sample immediately after stimulation (FIGS. 83B-C).

Figure 84:
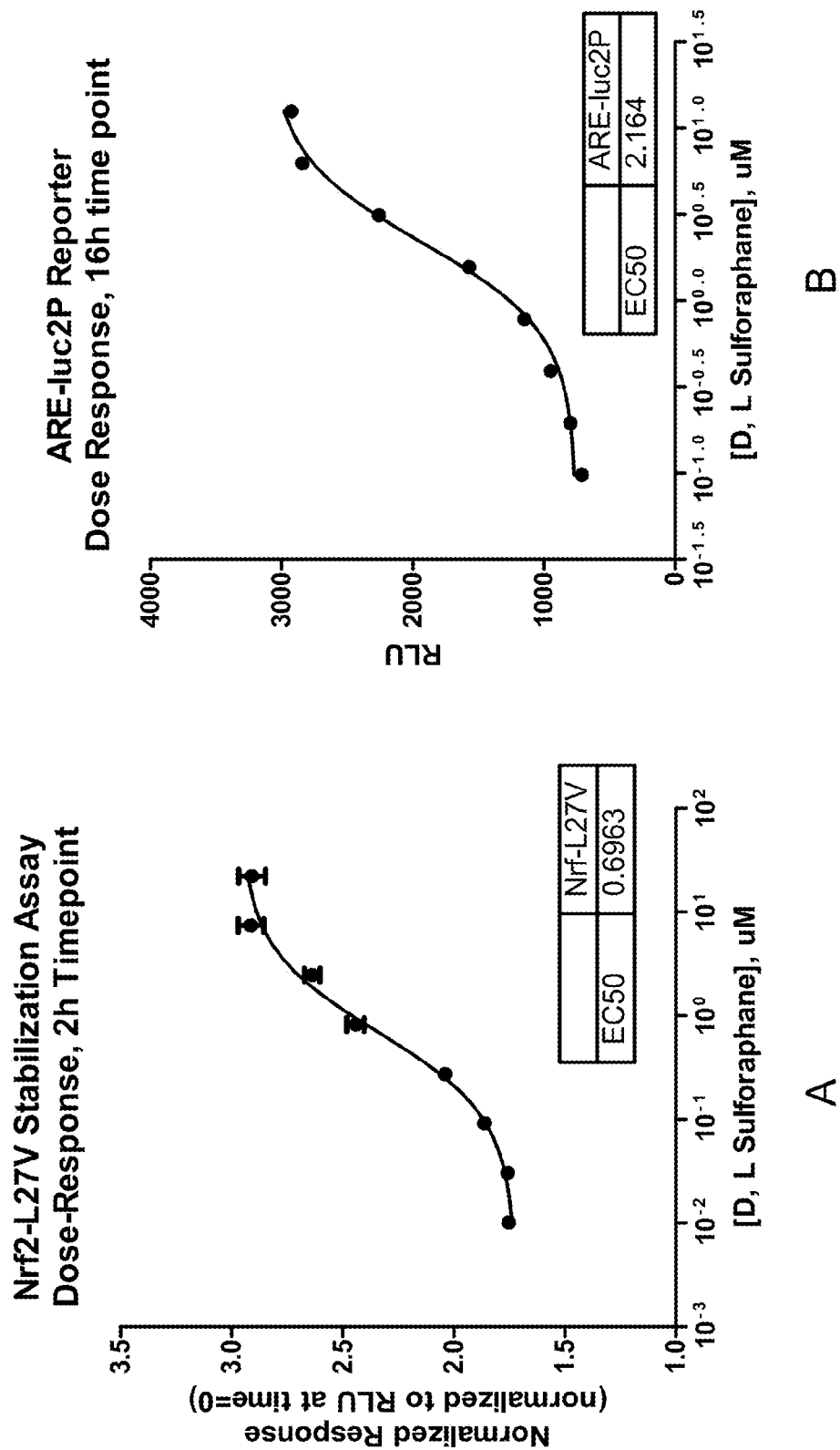
FIGS. 84A-B show the comparison of the Nrf2-L27V02 sensor (FIG. 84A) and Nrf2(ARE)-Luc2P reporter (FIG. 84B).
Figure 85:
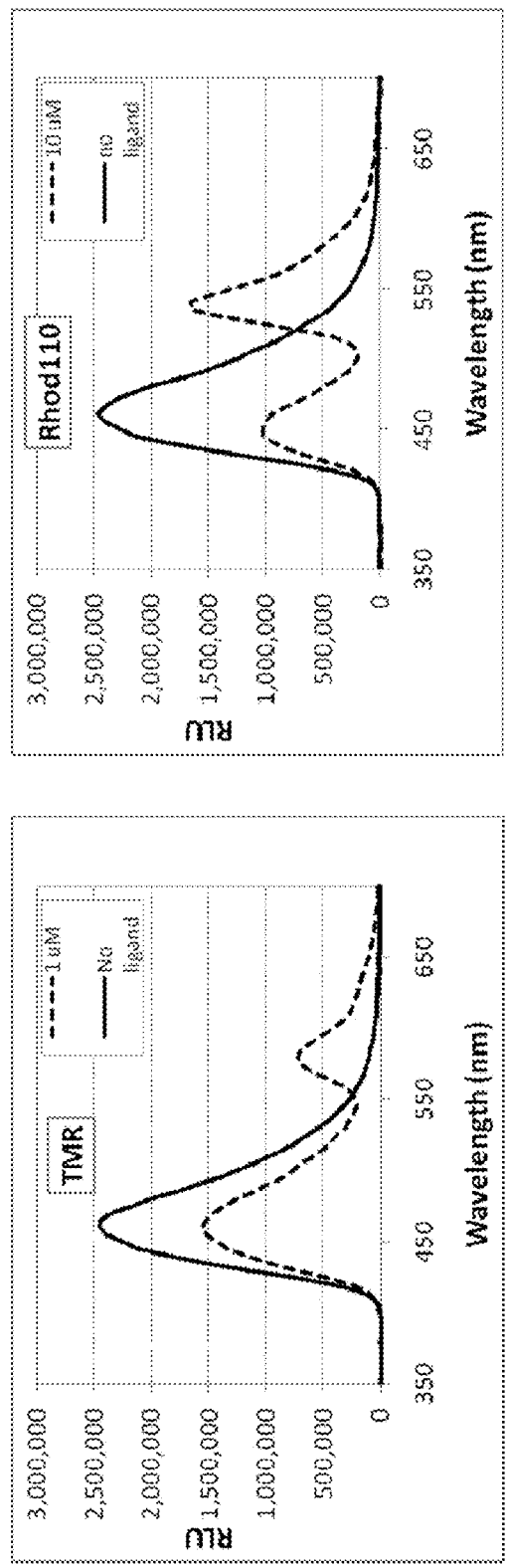
FIGS. 85A-B show the emission spectra of IV-HT7 with and without ligand, using 1 μM TMR (FIG. 85A) or 10 μM Rhodamine 110 (FIG. 85B) as a ligand for HT7 and coelenterazine-h as a substrate for IV.

C. A comparison of the response of the Nrf2 sensor described in B and Nrf2(ARE)-Luc2P reporter (Promega Corp.) was performed. Both the Nrf2 sensor and reporter were screened as described in section B above. For the firefly (Luc2P) reporter gene assay, the ONE-GLO™ assay reagent was used. FIGS. 84A-B provides the normalized response of Nrf2-L27V at 2 hrs and Nrf2(ARE)-Luc2P at 16 hrs Example 53—Evaluation of OgLuc Variant as Bioluminescent Reporter with BRET Bioluminescence resonance energy transfer (BRET) allows monitoring of protein-protein interactions. The intramolecular energy transfer was examined between IV and a HT7 fusion partner where HT7 was previously labeled with a fluorophore, i.e., TMR (excitation/emission (ex/em) wavelength=555/585 nm) or Rhodamine 110 (excitation/emission wavelength=502/527 nm). 50 µL of a bacterial cell lysate containing the IV-HT7 fusion protein of Example 34 was incubated with or without 0.001-10 µM fluorophore ligand for 1 hr at room temperature. After the incubation, 50 µL of *RENILLA*-GLO™, which contains 22 µM coelenterazine-h, was added to 50 µL of the enzyme-ligand mixture, and the emission spectrum was recorded at 5 min. Example spectra of IV-HT7 with TMR (FIG. 83A) or Rhodamine 110 ("Rhod110") (FIG. 85B) are shown indicating BRET was greater when the ex/em of the ligand was closer to the 460 nm luminescent peak of OgLuc, i.e., greater with Rhodamine 110. This data shows that intramolecular energy transfer can occur between OgLuc variants and a fluorophore on a fusion protein. Three different controls were used for comparison (data not shown): 1) a non-HT fusion, 2) a HT-fusion that was not labeled with a HT ligand, and 3) a labeled HT-fusion that was proteolytically cleaved at a TEV site between OgLuc and HT (which indicated the involvement of proximity/distance). BRET was not observed in the three different controls suggesting that HT was involved to achieve BRET. BRET was greater for C1+A4E and IV with a C-terminal HT7 compared to N-terminal HT7.

Example 54—Protein Proximity Assays for Live Cells or Lytic Formats

In one example, circularly permuted (CP) or straight split (SS) OgLuc fusion proteins is applied to measurements of protein proximity. OgLuc is permuted or split via insertion of a protease substrate amino acid sequence (e.g., TEV) to generate low bioluminescence. The inactive luciferase is tethered (e.g., via genetic fusion) to a monitor protein. A potential interacting protein is tethered (e.g., via genetic fusion) to a protease (e.g., TEV). When the two monitor proteins interact or are in sufficient proximity (e.g., via a constitutive interaction, a drug stimulus or a pathway response), the luciferase is cleaved to generate increased bioluminescence activity. The example may be applied to measurements of protein proximity in cells or in biochemical assays. Furthermore, the high thermal stability of an OgLuc variant luciferase could enable measurements of antibody-antigen interactions in lysed cells or biochemical assays.

Example 55—Bioluminescent Assays

Figure 86:
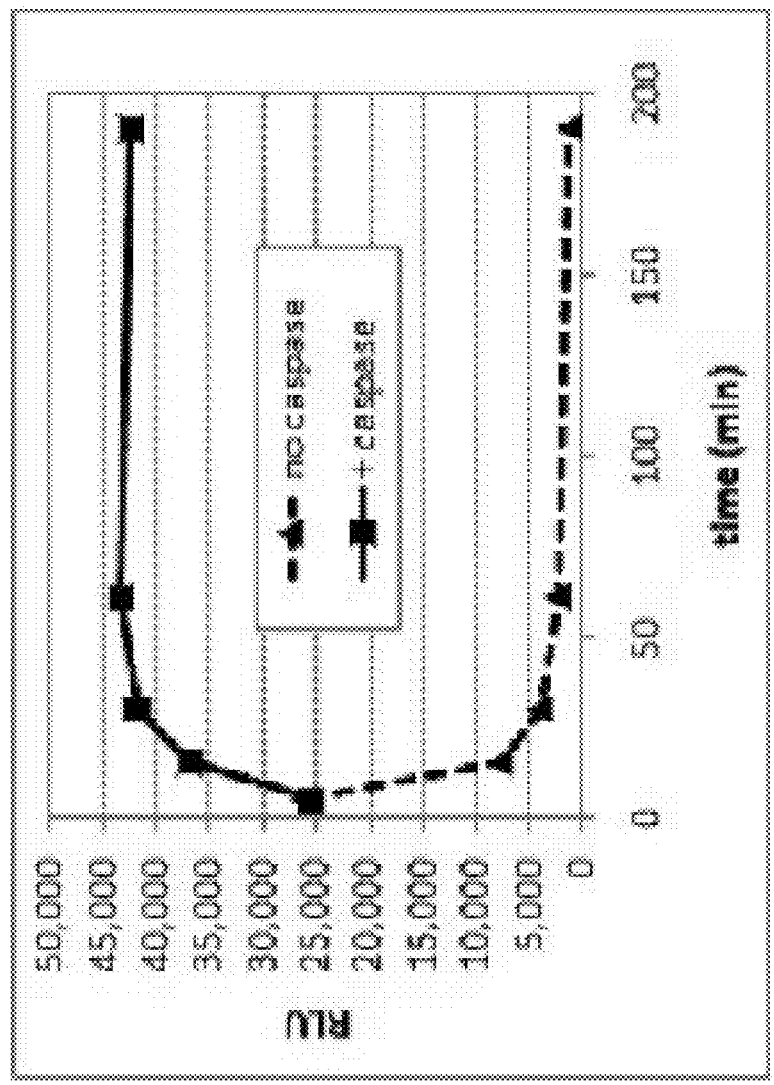
FIG. 86 shows the luminescence generated from lysed bacterial cells expressing 9B8 opt mixed with ("+caspase") or without ("no caspase") caspase-3 using a pro-coelenterazine substrate.

1. To demonstrate the use of an OgLuc variant in a bioluminescent assay to detect caspase-3 enzyme, the 9B8 opt variant was used in a bioluminescent assay using a pro-coelenterazine substrate comprising the DEVD caspase-3 cleavage sequence. Purified caspase-3 enzyme was mixed with an *E. coli* lysate sample expressing the variant 9B8 opt, which was prepared as described in Example 27, and diluted 10-fold in a buffer containing 100 mM MES pH 6.0, 1 mM CDTA, 150 mM KCl, 35 mM thiourea, 2 mM DTT, 0.25% TERGITOL® NP-9 (v/v), 0.025% MAZU® DF 204, with or without 23.5 µM z-DEVD-coelenterazine-h in 100 mM HEPES pH 7.5. The caspase-3 enzyme was incubated with the lysate sample for 3 hrs at room temperature, and luminescence detected on a Turner MODULUS™ luminometer at various time points. A sample containing only bacterial lysate and a sample containing only caspase-3 were used as controls. Three replicates were used. FIG. 86 and Table 44 demonstrate that 9B8 opt, and thus other OgLuc variants of the present invention, can be used in a bioluminescent assay with a pro-coelenterazine substrate to detect an enzyme of interest.

TABLE 44

Average luminescence in RLU generated from bacterial lysates expressing the 9B8 opt variant incubated with or without purified caspase-3 using z-DEVD-coelenterazine-h as a substrate.

| time (min) | no caspase (RLU) | + caspase (RLU) |
|---|---|---|
| 5 | 26,023 | 25,411 |
| 15.3 | 7,707 | 36,906 |
| 29.9 | 4,013 | 41,854 |
| 60.9 | 2,305 | 43,370 |
| 190.3 | 1,155 | 42,448 |

2. The L27V variant was used in a bioluminescent assay using a pro-coelenterazine substrate comprising the DEVD caspase-3 cleavage sequence. Purified caspase-3 enzyme (1 mg/mL) in 100 mM MES pH 6 (50 µL) was mixed with 227 nM L27V02 variant and 47 µM PBI-3741 (z-DEVD-coelenterazine-h) in assay buffer (50 µL). Reactions were incubated for 3 hrs at room temperature, and luminescence detected as previously described. The assay with the L27V variant was compared to a firefly luciferase version of the assay, CASPASE-GLO® 3/7-Assay system (Caspase-Glo; Promega Corp.). Table 45 demonstrate that L27V variant, and thus other OgLuc variants of the present invention, can be used in a bioluminescent assay with a pro-coelenterazine substrate to detect an enzyme of interest.

TABLE 45

|  | (+) caspase | +/− | (−) caspase | +/− |
|---|---|---|---|---|
| L27V | 11,532 | 93 | 803 | 25 |
| Caspase-Glo | 15,156,567 | 793,981 | 302 | 5 |

Example 56—Immunoassays

The OgLuc variants of the present invention are integrated into a variety of different immunoassay concepts. For example, an OgLuc variant is genetically-fused or chemically conjugated to a primary or secondary antibody to provide a method of detection for a particular analyte. As another example, an OgLuc variant is genetically-fused or chemically conjugated to protein A, protein G, protein L, or any other peptide or protein known to bind to Ig fragments, and this could then be used to detect a specific antibody bound to a particular analyte. As another example, an OgLuc variant is genetically-fused or chemically conjugated to streptavidin and used to detect a specific biotinylated antibody bound to a particular analyte. As another example, complementary fragments of an OgLuc variant are genetically-fused or chemically conjugated to primary and secondary antibodies, where the primary antibody recognizes a particular immobilized analyte, and the secondary antibody recognizes the primary antibody, all in an ELISA-like format. The OgLuc variant activity, i.e., luminescence, is reconstituted in the presence of immobilized analyte and used as a means to quantify the analyte.

As another example, complementary fragments of an OgLuc variant can be fused to two antibodies, where one antibody recognizes a particular analyte at one epitope, and the second antibody recognizes the analyte at a separate epitope. The OgLuc variant activity would be reconstituted in the presence of analyte. The method would be amenable to measurements of analyte quantification in a complex milieu such as a cell lysate or cell medium. As another example, complementary fragments of an OgLuc variant can be fused to two antibodies, where one antibody recognizes a particular analyte regardless of modification, and the second antibody recognizes only the modified analyte (for example, following post-translational modification). The OgLuc variant activity would be reconstituted in the presence of analyte only when it is modified. The method would be amenable to measurements of modified analyte in a complex milieu such as a cell lysate. As another example, an OgLuc variant can be conjugated to an analyte (e.g., prostaglandins) and used in a competitive sandwich ELISA format.

Example 57—Dimerization Assay

This example demonstrates that full-length circularly permuted OgLuc variants can be fused to respective binding partners, e.g., FRB and FKBP, and used in a protein complementation-type assay. The key difference between the method disclosed herein and traditional protein complementation is that there was no complementation, but rather there was dimerization of two full length enzymes, e.g., circularly permuted OgLuc variants.

Figure 87:
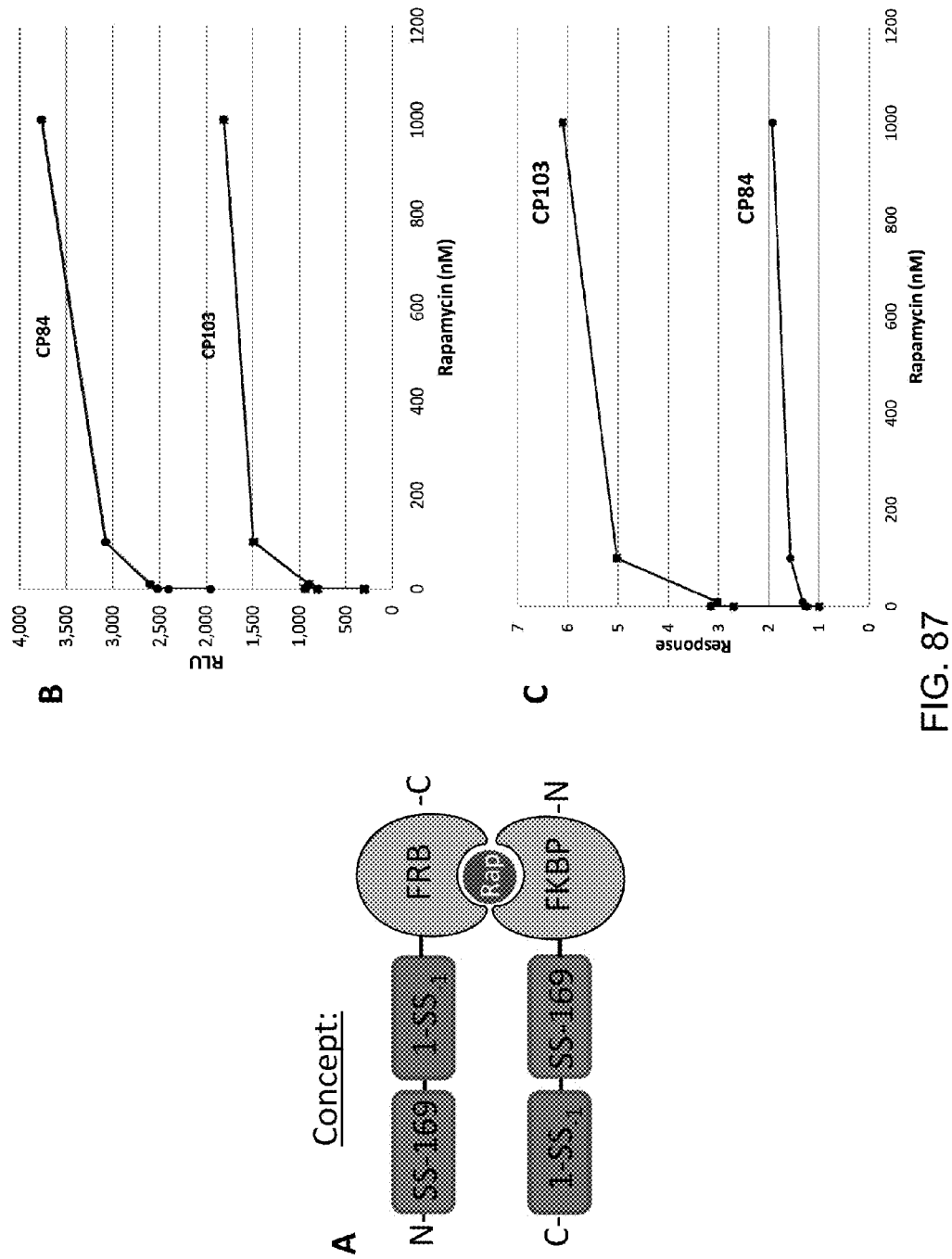
FIGS. 87A-C show the luminescence generated from circularly permuted, straight split L27V variants CP84 and CP103 using PBI-3939 as a substrate with (FIG. 87B) or without (not shown) rapamycin treatment and the response (FIG. 87C) due to rapamycin treatment. The concept of the circularly permuted straight split variants is shown in FIG. 87A.

Briefly, the circularly permuted reporter proteins similarly configured for low activity were fused to both of the fusion protein partners (See FIG. 87A). For example, each fusion partner may be linked to identically structured, permuted reporters. Interaction of the fusion partners brought the permuted reporters into close proximity, thereby allowing reconstitution of a hybrid reporter having higher activity. The new hybrid reporter included portions of each of the circularly permuted reporters in a manner to reduce the structural constraint.

Circularly permuted, straight split L27V variants CP84 and CP103 (N-(SS-169)-(1-SS$_1$)-FRB-C and C-(1-SS$_1$)-(SS-169)-FKBP) were cloned as previously described and expressed (25 µL) in rabbit reticulocyte lysate (RRL; Promega Corp.) following the manufacture's instructions. 1.25 µL of the expression reactions for each dimerization pair were mixed with 10 µL of 2× Binding Buffer (100 mM HEPES, 200 mM NaCl, 0.2% CHAPS, 2 mM EDTA, 20% glycerol, 20 mM DTT, pH 7.5) and 7.5 µL water, and 18 µL transferred to wells of a 96-well plate. To the reactions, 2 µL rapamycin (final concentration 0 and 0.1-1000 nM) was added, and the reactions incubated at room temperature for 10 min. Following incubation, 100 µL of PBI-3939 (50× stock diluted to 1× in assay buffer) and incubated for 3 min at room temperature. Luminescence was measured on a GLOMAX® luminometer (FIG. 87B) and the response was determined (FIG. 87C). FIGS. 87B-C demonstrates that the OgLuc variants of the present invention can be used to detect protein-protein interactions via a PCA-type dimerization assay.

Example 58—Intercellular Half-Life

The intracellular half-life of the OgLuc variants 9B8, 9B8+K33N, V2, L27V, and V2+L27M were determined CHO cells (500,000) in 15-100 mm plates in F12 media with 10% FBS and 1× sodium pyruvate were transfected with 30 µL 100 ng/µL plasmid DNA containing 9B8, 9B8+K33N, V2, L27V ("V2+L27V") or V2+L27M (all in pF4A vector background) using TRANSIT®-LT1 (Mirus) according to the manufacture's instructions. The cells were then incubated for 6 hrs.

After incubation, the media was removed and 1 mL Trypsin added to dissociate the cells from the plate. 3 mL of F12 media was then added, and the cells counted. Cells were then plated at 10,000 cells/well into 6 wells of a 96-well plate (6 wells/variant) and incubated overnight at 37° C. Samples were distributed over 3 plates. Each plate had 6 replicates for different time point measurements.

After overnight incubation, the media was removed from the cells for t=0 samples, and 100 µL assay buffer (previously described; no substrate) was added. The sample was frozen on dry ice and stored at −20° C. Cycloheximide (100 mg/mL) was diluted 1:100 to a final concentration of 1 mg/mL in OPTI-MEM®. DMSO (100%) was also diluted 1:100 (final concentration 1%) in OPTI-MEM®. The diluted cycloheximide (1 mg/mL) was added (11 µL) to 3 replicates of each transfected variant sample and 11 µL of the diluted DMSO (1%) was added to the other 3 replicates. The cells were then incubated at 37° C., 5% $CO_2$ and removed at various timepoints (i.e., 0, 0.5, 0.9, 2.5, 4.3, and 6.2 hrs) and processed as the t=0 samples.

For analysis, the samples were thawed to room temperature, and 10 µL assayed in 50 µL assay reagent. Luminescence was measured on a GLOMAX® luminometer. At each time-point, luminescence was measured for untreated and cycloheximide-treated samples. The RLU for the cells treated with cycloheximide was normalized by the RLU for the untreated cells.

The intracellular half-life of each variant was calculated by measuring the ratio of the luminescence from the cycloheximide (CHX)-treated to the untreated at each time-point. The ratio was then plotted ln (% treated to untreated) over time, and the half-life calculated (Table 46). The OgLuc variants had intracellular half-lives of approximately 6-9 hrs with a full strength CMV promoter, but the half lives were reduced with a CMV deletion variant (d2). The presence of a PEST degradation signal combined with the full strength CMV promoter reduces half-life significantly.

TABLE 46

| Sample | CMV no deg. | CMV d2 no deg. | CMV Pest |
|---|---|---|---|
| 9B8 | 6.32 | 3.87 | 1.43 |
| K33N | 9.24 | 3.70 | 1.18 |
| V2 | 9.63 | 4.28 | 1.61 |
| V2 + L27V | 6.66 | 4.78 | 1.63 |
| V2 + L27M | 8.89 | 6.98 | 1.63 |

Another experiment was completed using the reverse transfection protocol described in Example 52 with HEK293 cells (data not shown). The results from this experiment indicate that the intracellular half-life for the L27V variant with PEST is 10 min. The L27V variant with no degradation signal used in this experiment did not show a decay over the course of this experiment. In this case the decay was normalized to untreated cells at t=0.

Example 59—Exposure of OgLuc Variants to Urea

Figure 88:
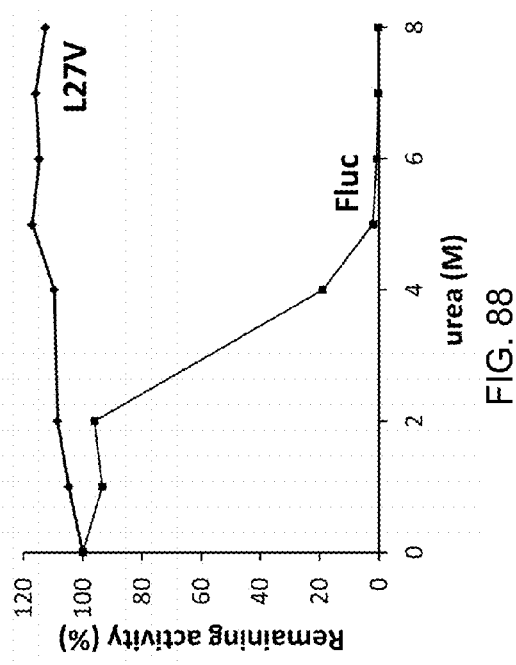
FIG. 88 shows percent remaining activity of the L27V variant after exposure to various amounts of urea.

Since Firefly luciferase is known to be relatively unstable, it is much more sensitive to urea exposure. To determine whether this was also the case with the OgLuc variants, the sensitivity of the OgLuc to urea was determined 5 µl of 45.3 µM L27V enzyme was mixed with 100 µL of a urea solution (100 mM MOPS, pH 7.2, 100 mM NaCl, 1 mM CDTA, 5% glycerol and various concentrations of urea) and incubated for 30 min at room temperature. 5 µL of the urea+L27V enzyme solution was diluted 10,000-fold into DMEM without phenol red+0.1% PRIONEX®, 50 µL was mixed with 50

µL of assay reagent containing 100 µM PBI-3939 (previously described) and the luminescence was read at 10 min. (FIG. 88). FIG. 88 indicates that L27V is either resistant to urea or refolds to a functional enzyme very quickly upon removal of urea. This suggests that L27V could be used as a reporter enzyme when chemical denaturing conditions are involved, e.g., multiplexing in conditions where a denaturant is used to stop an enzymatic reaction prior to the OgLuc variant-based reaction.

Figure 89:
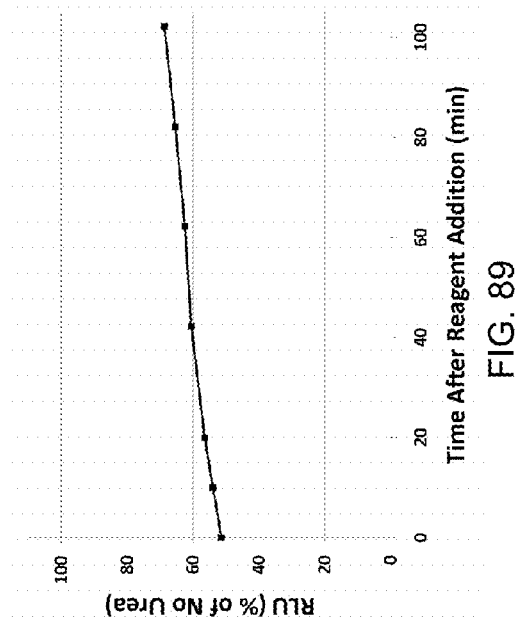
FIG. 89 shows the effect of 3M urea on the activity of the L27V variant.

A 0.31 mg/mL stock of purified L27V variant was diluted 100,000-fold into buffer (PBS+1 mM DTT+0.005% IGEPAL) and incubated with 3 M urea for 30 min at 25° C. and then mixed 1:1 (50 µL+50 µL) with an assay reagent containing 100 µM PBI-3939 (previously described). The reactions were read on a TECAN® INFINITE® F500 luminometer as described previously (for 100 min; 1 min read intervals) (FIG. 89). The results indicate that 3M urea reduces the activity of L27V variant by approximately 50%, but, upon diluting out the urea by 2-fold (to a 1.5 M final concentration) the activity increases, presumably due to refolding.

Example 60—Imaging of OgLuc Fusion Proteins

This example demonstrates the use of OgLuc and OgLuc variants to monitor protein translocation in living cells without the need for fluorescence excitation. OgLuc variants were fused to human glucocorticoid receptor (GR; SEQ ID NOs: 451 and 452), human protein kinase C alpha (PKCa; SEQ ID NOs: 449 and 450) or LC3 (SEQ ID NOs: 577 and 578). To analyze subcellular protein translocation using bioluminescence imaging, HeLa cells were plated at $2 \times 10^4$ cells/cm$^2$ into glass-bottom culture dishes (MatTek) in DMEM medium (Invitrogen) containing 10% FBS. The cells were then incubated for 24 hrs at 37° C., 5% CO2. Cells were then transfected with ¹⁄₂₀ volume transfection mixture (FUGENE® HD and DNA encoding L27V02-GR (SEQ ID NOs: 453 and 454) or L27V02-PKC alpha (SEQ ID NOs: 455 and 456) cloned into the pFSA vector (Promega Corp.)). The plasmid DNA for L27V02-GR was diluted 1:20 into pGEM-3ZF (Promega Corp.) to achieve appropriate expression levels of L27V02-GR. The plasmid DNA for L27V02-LC3 and L27V02-PKC alpha was used undiluted. Cells were then incubated for 24 hrs at 37° C., 5% $CO_2$. Cells transfected with GR fusion proteins were starved of GR agonist for 20 hrs using MEM medium supplemented with 1% charcoal/dextran-treated FBS (Invitrogen). Twenty-four hrs post-transfection (for PKC alpha measurements) or 48 hrs post-transfection (for GR measurements), the cell media was replaced with $CO_2$-independent media containing 100 µM PBI-3939 immediately before imaging. Unfiltered images were immediately captured on an Olympus LV200 bioluminescence microscope using a 150× objective.

Cytosol-to-nucleus translocation of L27V02-GR fusion protein was achieved via stimulation with 0.5 mM dexamethasone for 15 min. Cytosol-to-plasma membrane translocation of L27V02-PKC alpha fusion protein was achieved via stimulation with 100 nM PMA for 20 min. L27V02-LC3 fusion protein transfected cells were left untreated or treated with 50 mM Chloroquine in DMEM medium (Invitrogen) containing 10% FBS.

L27V02-Glucocorticoid Receptor

In the absence of glucocorticoids, glucocorticoid receptor (GR) is complexed to Hsp90 proteins and resides in the cytosol. Upon interaction of GR with glucocorticoids, such as dexamethasone, GR proteins dissociate from these protein complexes and translocate to the nucleus to regulate gene transcription. FIGS. 90A-B show the bioluminescence imaging of dexamethasone-induced cytosol to nuclear receptor (NR) translocation of L27V02-glucocorticoid receptor (GR) fusion proteins using PBI-3939 substrate in HeLa cells.

L27V02-PKCa

Upon treatment with phorbol esters, PKC alpha proteins are recruited to the plasma membrane and regulate cellular responses including membrane dynamics and signal transduction. FIGS. 91A-B show the bioluminescence imaging of phorbol ester-induced Protein Kinase C alpha (PKC alpha) cytosol to plasma membrane translocation of OgLuc L27V02-PKC alpha fusions using PBI3939 substrate in U-20S cells.

L27V-LC3

Figure 92:
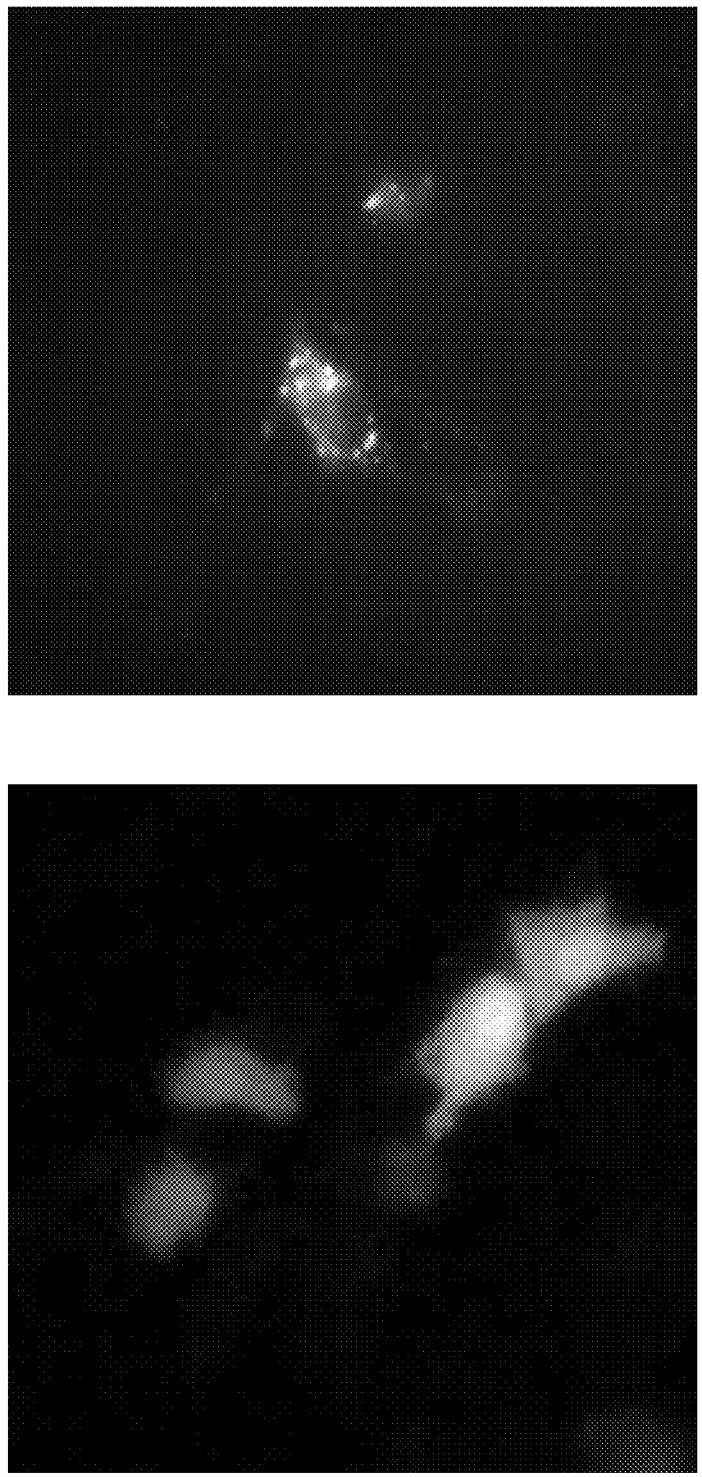
FIGS. 92A-B show the bioluminescence imaging of autophagosomal protein translocation of OgLuc fusions using PBI-3939 substrate.

Association of processed LC-3 proteins with autophagosomes represents a hallmark step in autophagy. Chloroquine treatment arrests autophagic flux at this stage, resulting in accumulation of LC-3 proteins on autophagosomes (producing a punctuate subcellular distribution). FIGS. 92A-B show the bioluminescence imaging of chloroquine-induced autophagosomal protein translocation of OgLuc L27V-LC3 fusions proteins (SEQ ID NOs: 592 and 593) using PBI-3939 substrate in two representative HeLa cell samples.

TABLE 47

Proviso List

| C1 + A4E | Additional Substitutions | | | | |
|---|---|---|---|---|---|
| C1 + A4E | L92G | | | | |
| C1 + A4E | L92Q | | | | |
| C1 + A4E | L92S | | | | |
| C1 + A4E | L92A | | | | |
| C1 + A4E | L72Q | | | | |
| C1 + A4E | I90T | | | | |
| C1 + A4E | Q20R | | | | |
| C1 + A4E | C164S | | | | |
| C1 + A4E | M75K | | | | |
| C1 + A4E | V79I | | | | |
| C1 + A4E | F54I | | | | |
| C1 + A4E | K89E | | | | |
| C1 + A4E | I90V | | | | |
| C1 + A4E | F77W | F68S | I90V | | |
| C1 + A4E | F54I | M75K | | | |
| C1 + A4E | F54I | M75K | I90V | | |
| C1 + A4E | F54I | F68S | M75K | | |
| C1 + A4E | F54I | I90V | | | |
| C1 + A4E | F54I | | | | |
| C1 + A4E | F54T | N135K | I167V | P104L | D139E |
| C1 + A4E | V45E | L34M | G51V | I99V | I143L |
| C1 + A4E | S28P | L34M | G51V | I99V | I143L | F54T |
| C1 + A4E | S28P | L34M | G51V | I99V | I143L | F54T |
| C1 + A4E | S28P | | | | |

SEQUENCE LISTING

SEQ ID NO: 1 (Native mature OgLuc protein) Oplophorus gracilirostris
FTLADFVGDWQQTAGYNQDQVLEQGGLSSLFQALGVSVTPIQKVVLSGENGLKADIHVIIPYEGLSGFQMGLIEMIFK
VVYPVDDHHFKIILHYGTLVIDGVTPNMIDYFGRPYPGIAVFDGKQITVTGTLWNGNKIYDERLINPDGSLLFRVTIN
GVTGWRLCENILA

SEQUENCE LISTING

SEQ ID NO: 2 (C1A4E nucleotide)
ATGGTGTTTACATTGGAGGATTTCGTTGGAGACTGGCGGCAGACAGCTGGATACAACCAAGATCAAGTGTTAGAACAA
GGAGGATTGTCTAGTCTGTTCCAAAAGCTGGGAGTGTCAGTCACCCCAATCCAGAAAATTGTGCTGTCTGGGGAGAAT
GGGTTAAAAATTTGATATTCATGTCATCATCCCTTACGAGGGACTCAGTGGTTTTCAAATGGGTCTGATTGAAATGATC
TTCAAAGTTGTTTACCCAGTGGATGATCATCATTTCAAGATTATTCTCCATTATGGTACACTCGTTATTGACGGTGTG
ACACCAAACATGATTGACTACTTTGGACGCCCTTACGAGGGAATTGCTGTGTTTGACGGCAAGAAGATCACAGTTACT
GGAACTCTGTGGAACGGCAACAAGATCATTGATGAGCGCCTGATCAACCCAGATGGTTCACTCCTCTTCCGCGTTACT
ATCAATGGAGTCACCGGATGGCGCCTTTGCGAGCGTATTCTTGCC SEQ ID NO: 3 (C1A4E protein)
MVFTLEDFVGDWRQTAGYNQDQVLEQGGLSSLFQKLGVSVTPIQKIVLSGENGLKFDIHVIIPYEGLSGFQMGLIEMI
FKVVYPVDDHHFKIILHYGTLVIDGVTPNMIDYFGRPYEGIAVFDGKKITVTGTLWNGNKIIDERLINPDGSLLFRVT
INGVTGWRLCERILA SEQ ID NO: 4 (QC27 nucleotide)
ATGGTGTTTACATTGGAGGATTTCGTTGGAGACTGGCGGCAGACAGCTGGATACAACCTAGATCAAGTGTTAGAACAA
GGAGGATTGTCTAGTCTGTTCCAAAAGCTGGGAGTGTCAGTCACCCCAATCCAGAAAATTGTGCTGTCTGGGGAGAAT
GGGTTAAAAATTGATATTCATGTCATCATCCCTTACGAGGGACTCAGTGGTTTTCAAATGGGTCTGATTGAAATGATC
TTCAAAGTTGTTTACCCAGTGGATGATCATCATTTCAAGATTATTCACCATTATGGTACACTCGTTATTGACGGTGTG
ACACCAAACATGATTGACTTCTTTGGACGCCCTTACGAGGGAATTGCTGTGTTTGACGGCAAGAAGATCACAGTTACT
GGAACTCTGTGGAACGGCAACAAGATCATTGATGAGCGCCTGATCAACCCAGATGGTTCACTCCTCTTCCGCGTTACT
ATCAATGGAGTCACCGGATGGCGCCTTTGCGAGCGTATTCTTGCC SEQ ID NO: 5 (QC27 protein)
MVFTLEDFVGDWRQTAGYNLDQVLEQGGLSSLFQKLGVSVTPIQKIVLSGENGLKIDIHVIIPYEGLSGFQMGLIEMI
FKVVYPVDDHHFKIIHHYGTLVIDGVTPNMIDFFGRPYEGIAVFDGKKITVTGTLWNGNKIIDERLINPDGSLLFRVT
INGVTGWRLCERILA SEQ ID NO: 6 (QC27 9a nucleotide)
ATGGTGTTTACATTGGAGGATTTCGTTGGAGACTGGCGGCAGACAGCTGGATACAACCTAGATCAACTGTTAGAACAA
GGAGGATTGTCTAGTCTGTTCCAAAAGCTGGGAGTGTCAGTCACCCCAATCCAGAAAATTGTGCTGTCTGGGGAGAAT
GGGTTAAAAATTGATATTCATGTCATCATCCCTTACGAGGGACTCAGTGGTTATCAAATGGGTCAGATTGAAAAGATC
TTCAAAGTTGTTTACCCAGTGGATGATCATCATTTCAAGATTATTCGCCATTATGGTACACTCGTTATTGACGGTGTG
ACACCAAACATGATTGACTTCTTTGGACGCCCTTACGAGGGAATTGCTGTGTTTGACGGCAAGAAGATCACAGTTACT
GGAACTCTGTGGAACGGCAACAAGATCATTGATGAGCGCCTGATCAACCCAGATGGTTCACTCCTCTTCCGCGTTACT
ATCAATGGAATCACCGGATGGCGCCTTTGCGAGCGTATTCTTGCC SEQ ID NO: 7 (QC27 9a protein)
MVFTLEDFVGDWRQTAGYNLDQLLEQGGLSSLFQKLGVSVTPIQKIVLSGENGLKIDIHVIIPYEGLSGYQMGQIEKI
FKVVYPVDDHHFKIIRHYGTLVIDGVTPNMIDFFGRPYEGIAVFDGKKITVTGTLWNGNKIIDERLINPDGSLLFRVT
INGITGWRLCERILA SEQ ID NO: 8 (IVY nucleotide)
ATGGTGTTTACATTGGAGGATTTCGTTGGAGACTGGCGGCAGACAGCTGGATACAACCAAGATCAAGTGTTAGAACAA
GGAGGATTGTCTAGTCTGTTCCAAAAGCTGGGAGTGTCAGTCACCCCAATCCAGAAAATTGTGCTGTCTGGGGAGAAT
GGGTTAAAAATTGATATTCATGTCATCATCCCTTACGAGGGACTCAGTGGTTTTCAAATGGGTCTGATTGAAATGATC
TACAAAGTTGTTTACCCAGTGGATGATCATCATTTCAAGGTTATTCTCCATTATGGTACACTCGTTATTGACGGTGTG
ACACCAAACATGATTGACTACTTTGGACGCCCTTACGAGGGAATTGCTGTGTTTGACGGCAAGAAGATCACAGTTACT
GGAACTCTGTGGAACGGCAACAAGATCATTGATGAGCGCCTGATCAACCCAGATGGTTCACTCCTCTTCCGCGTTACT
ATCAATGGAGTCACCGGATGGCGCCTTTGCGAGCGTATTCTTGCC SEQ ID NO: 9 (IVY protein)
MVFTLEDFVGDWRQTAGYNQDQVLEQGGLSSLFQKLGVSVTPIQKIVLSGENGLKIDIHVIIPYEGLSGFQMGLIEMI
YKVVYPVDDHHFKVILHYGTLVIDGVTPNMIDYFGRPYEGIAVFDGKKITVTGTLWNGNKIIDERLINPDGSLLFRVT
INGVTGWRLCERILA SEQ ID NO: 10 (IVY+C1.3 nucleotide)
ATGGTGTTTACATTGGAGGATTACGTTGGAGACTGGCGGCAGACAGCTGGATACAACCAAGATCAAGTGTTAGAACAA
GGAGGATTGTCTAGTCTGTTCCAAAATCTGGGAGTGTCTGTCACCCCAATCCAGAAAATTGTGCTGTCTGGGGAGAAT
GGGTTAAAAATTGATATTCATGTCATCATCCCTTACGAGGGACTCAGTGGTTTCAAATGGGTCTGATTGAAATGATC
TACAAAGTTGTTTACCCAGTGGATGATCATCATTTCAAGGTTATTCTCCATTATGGTACACTCGTTATTGACGGTGTG
ACACCAAACATGATTGACTACTTTGGACGCCCTTACGAGGGAATTGCTGTGTTTGACGGCAAGAAGATCACAGTTACT
GGAACTCTGTGGAACGGCGACAAGATCATTGATGAGCGCCTGATCAACCCAGATGGTTCACTCCTCTTCCGCGTTACT
ACCAATGGAGTCACCGGATGGCGCCTTTGCGAGCGTATTCTTGCC SEQ ID NO: 11 (IVY+C1.3 protein)
MVFTLEDYVGDWRQTAGYNQDQVLEQGGLSSLFQNLGVSVTPIQKIVLSGENGLKIDIHVIIPYEGLSGFQMGLIEMI
YKVVYPVDDHHFKVILHYGTLVIDGVTPNMIDYFGRPYEGIAVFDGKKITVTGTLWNGDKIIDERLINPDGSLLFRVT
TNGVTGWRLCERILA SEQ ID NO: 12 (IVY C5.19 nucleotide)
ATGGTGTTTACATTGGAGGATTTCGTTGGAGACTGGCGGCAGACAGCTGGATACAACCAAGATCAAGTGTTAGAACAA
GGAGGAGTGTCTAGTCTGTTCCAAAAGCTGGGAGTGTCAATCACCCCAATCCAGAAAATTGTGCTGTCTGGGGAGAAT
GGGTTAAAAATTGATATTCATGTCATCATCCCTTACGAGGGACTCAGTGGTTTTCAAATGGGTCTGATTGAAATGATC
TACAAAGTTGTTTACCCAGTGGATGATCATCATTTCAAGGTTATTCTCCATTATGGTACACTCGTTATTGACGGTGTG
ACACCAAACATGATTGACTACTTTGGACGCCCTTACGAGGGAATTGCTGTGTTTGACGGCAAGAAGATCACAGTTACT

```
                              SEQUENCE LISTING

GGAACTCTGTGGAACGGCAACAAGATCATTGATGAGCGCCTGATCAACCCAGATGGTTCAATCCTCTTCCGCGTTACT
ATCAATGGAGTCACCGGATGGCGCCTTTGCGAGCGTATTCTTGCC

SEQ ID NO: 13 (IVY C5.19 protein)
MVFTLEDFVGDWRQTAGYNQDQVLEQGGVSSLFQKLGVSITPIQKIVLSGENGLKIDIHVIIPYEGLSGFQMGLIEMI
YKVVYPVDDHHFKVILHYGTLVIDGVTPNMIDYFGRPYEGIAVFDGKKITVTGTLWNGNKIIDERLINPDGSILFRVT
INGVTGWRLCERILA SEQ ID NO: 14 (IV nucleotide)
ATGGTGTTTACATTGGAGGATTTCGTTGGAGACTGGCGGCAGACAGCTGGATACAACCAAGATCAAGTGTTAGAACAA
GGAGGATTGTCTAGTCTGTTCCAAAAGCTGGGAGTGTCAGTCACCCCAATCCAGAAAATTGTGCTGTCTGGGGAGAAT
GGGTTAAAAATTGATATTCATGTCATCATCCCTTACGAGGGACTCAGTGGTTTTCAAATGGGTCTGATTGAAATGATC
TTCAAAGTTGTTTACCCAGTGGATGATCATCATTTCAAGGTTATTCTCCATTATGGTACACTCGTTATTGACGGTGTG
ACACCAAACATGATTGACTACTTTGGACGCCCTTACGAGGGAATTGCTGTGTTTGACGGCAAGAAGATCACAGTTACT
GGAACTCTGTGGAACGGCAACAAGATCATTGATGAGCGCCTGATCAACCCAGATGGTTCACTCCTCTTCCGCGTTACT
ATCAATGGAGTCACCGGATGGCGCCTTTGCGAGCGTATTCTTGCC SEQ ID NO: 15 (IV protein)
MVFTLEDFVGDWRQTAGYNQDQVLEQGGLSSLFQKLGVSVTPIQKIVLSGENGLKIDIHVIIPYEGLSGFQMGLIEMI
FKVVYPVDDHHFKVILHYGTLVIDGVTPNMIDYFGRPYEGIAVFDGKKITVTGTLWNGNKIIDERLINPDGSLLFRVT
INGVTGWRLCERILA SEQ ID NO: 16 (15C1 nucleotide)
ATGGTGTTTACATTGAAGGATTTCGTTGGAGACTGGCGGCAGACAGCTGGATACAACCAAGATCAAGTGTTAGAACAA
GGAGGATTGTCTAGTCTGTTCCAAAATCTGGGAGTGTCAGTCACCCCAATCCAGAAAATTGTGCTGTCTGGGGAGAAT
GGGTTAAAAATTGATATTCATGTCATCATCCCTTACGAGGGACTCAGTGGTTATCAAATGGGTCAGATTGAAAAGATC
TTCAAAGTTGTTTACCCAGTGGATGATCATCATTTCAAGGTTATTCTCCATTATGGTACACTCGTTATTGACGGTGTG
ACACCAAACATGATTGACTACTTTGGACGCCCTTACGAGGGAATTGCTGTGTTTGACGGCAAGAAGATCACAGTTACT
GGAACTCTGTGGAACGGCAACAAGATCATTGATGAGCGCCTGATCAACCCAGATGGTTCACTCCTCTTCCGCGTTACT
ATCAATGGAGTCACCGGATGGCGCCTTTGCGAGCGTATTCTTGCC SEQ ID NO: 17 (15C1 protein)
MVFTLKDFVGDWRQTAGYNQDQVLEQGGLSSLFQNLGVSVTPIQKIVLSGENGLKIDIHVIIPYEGLSGYQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILA SEQ ID NO: 18 (9B8 nucleotide)
ATGGTGTTTACATTGGAGGATTTCGTTGGAGACTGGCGGCAGACAGCTGGATACAACCTAGATCAAGTGTTAGAACAA
GGAGGATTGTCTAGTCTGTTCCAAAAGCTGGGAGTGTCAGTCACCCCAATCCAGAAAATTGTGCTGTCTGGGGAGAAT
GGGTTAAAAATTGATATTCATGTCATCATCCCTTACGAGGGACTCAGTGGTTATCAAATGGGTCAGATTGAAAAGATC
TTCAAAGTTGTTTACCCAGTGGATGATCATCATTTCAAGGTTATTCTCCATTATGGTACACTCGTTATTGACGGTGTG
ACACCAAACATGATTGACTACTTTGGACGCCCTTACGAGGGAATTGCTGTGTTTGACGGCAAGAAGATCACAGTTACT
GGAACTCTGTGGAACGGCAACAAGATCATTGATGAGCGCCTGATCAACCCAGATGGTTCACTCCTCTTCCGCGTTACT
ATCAATGGAGTCACCGGATGGCGCCTTTGCGAGCGTATTCTTGCC SEQ ID NO: 19 (9B8 protein)
MVFTLEDFVGDWRQTAGYNLDQVLEQGGLSSLFQKLGVSVTPIQKIVLSGENGLKIDIHVIIPYEGLSGYQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILA SEQ ID NO: 20 (9F6 nucleotide)
ATGGTGTTTACATTGGAGGATTTCGTTGGAGACTGGCGGCAGACAGCTGGATACAACCTAGATCAAGTGTTAGAACAA
GGAGGAGTGTCTAGTCTGTTCCAAAAGCTGGGAGTGTCAATCACCCCAATCCAGAAAATTGTGCTGTCTGGGGAGAAT
GGGTTAAAAATTGATATTCATGTCATCATCCCTTACGAGGGACTCAGTGGTTATCAAATGGGTCAGATTGAAAAGATC
TTCAAAGTTGTTTACCCAGTGGATGATCATCATTTCAAGGTTATTCTCCATTATGGTACACTCGTTATTGACGGTGTG
ACACCAAACATGATTGACTACTTTGGACGCCCTTACGAGGGAATTGCTGTGTTTGACGGCAAGAAGATCACAGTTACT
GGAACTCTGTGGAACGGCAACAAGATCATTGATGAGCGCCTGATCAACCCAGATGGTTCACTCCTCTTCCGCGTTACT
ATCAATGGAGTCACCGGATGGCGCCTTTGCGAGCGTATTCTTGCC SEQ ID NO: 21 (9F6 protein)
MVFTLEDFVGDWRQTAGYNLDQVLEQGGVSSLFQKLGVSITPIQKIVLSGENGLKIDIHVIIPYEGLSGYQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILA SEQ ID NO: 22 (IV opt nucleotide)
atggtgtttacactcgaagatttcgtaggggactggcggcagacagccggctacaaccaagaccaagtccttgagcag
ggcggtctgtccagtttgtttcagaaactcggggtgtccgtaacaccgatccaaaagattgtcctgagcggtgaaaac
ggcctgaagatcgacatccatgtcatcatcccgtatgaaggtctgagcggcttccagatgggcctcattgagatgatc
tttaaggtggtgtaccctgtggatgatcatcactttaaggtgattctgcactatggcacactggtaatcgacggggtt
acgccgaacatgatcgactatttcggacgccgtatgaaggcatcgccgtgttcgacggcaaaaagatcactgtaacc
gggaccctgtggaacggcaacaaaattatcgacgagcgcctgatcaaccccgacggctccctgctgttccgcgtaacc
atcaacggagtgaccggctggcggctgtgcgagcgcatttttggcg SEQ ID NO: 23 (IV optB nucleotide)
atggtattcacactggaggattttgtcggtgattggcggcaaaccgctgggtacaaccaggaccaggttctcgaacaa
gggggcctcagctcccctgtttcaaaaactgggtgttagcgttacacctattcaaaaaatcgtgctctccggggaaaac
gggctcaaaatcgatattcatgtgattatcccttacgaagggctctccgggtttcagatggggctgatcgaaatgatc
```

```
tttaaggtcgtctatcccgtagatgatcaccacttcaaggtgatcctccactacgggaccctcgtaattgatggcgtg
accccccaacatgatcgactattttgggcgcccttacgaggggattgctgtcttcgatggcaaaaaaattacagtgaca
ggcacactctggaacgggaataagatcattgatgagcgcctgattaatcccgatgggagcctgctctttcgggtgaca
attaacggcgtaacaggctggcgcctctgtgaacggattctggcg
```

SEQ ID NO: 24 (9B8 opt nucleotide)
```
atggtgtttacactcgaagatttcgtagggggactggcggcagacagccggctacaacctggaccaagtccttgagcag
ggcggtctgtccagtttgtttcagaaactcggggtgtccgtaacaccgatccaaaagattgtcctgagcggtgaaaac
ggcctgaagatcgacatccatgtcatcatcccgtatgaaggtctgagcggctatcagatgggccagatcgaaaaaatt
tttaaggtggtgtaccctgtggatgatcatcactttaaggtgattctgcactatggcacactggtaatcgacggggtt
acgccgaacatgatcgactatttcggacggccgtatgaaggcatcgccgtgttcgacggcaaaaagatcactgtaacc
gggaccctgtggaacggcaacaaaattatcgacgagcgcctgatcaaccccgacggctccctgctgttccgcgtaacc
atcaacggagtgaccggctggcggctgtgcgagcgcattttggcg
```

SEQ ID NO: 25 (9B8 optB nucleotide)
```
atggtattcacactggaggattttgtcggtgattggcggcaaaccgctgggtacaacctcgaccaggttctcgaacaa
gggggcctcagctccctgtttcaaaaactgggtgttagcgttacacctattcaaaaaatcgtgctctccggggaaaac
gggctcaaaatcgatattcatgtgattatcccttacgaagggctctccgggtatcagatggggcagatcgaaaaaatc
tttaaggtcgtctatcccgtagatgatcaccacttcaaggtgatcctccactacgggaccctcgtaattgatggcgtg
accccccaacatgatcgactattttgggcgcccttacgaggggattgctgtcttcgatggcaaaaaaattacagtgaca
ggcacactctggaacgggaataagatcattgatgagcgcctgattaatcccgatgggagcctgctctttcgggtgaca
attaacggcgtaacaggctggcgcctctgtgaacggattctggcg
```

SEQ ID NO: 26 (8A3 nucleotide)
```
Atggtgattacattggaggatttcgttggagactggcggcagacagctggatacaaccaagatcaagtgttagaacaa
ggaggagtgtctagtctgttccaaaagctgggagtgtcaatcaccccaatccagaaaattgtgctgtctggggagaat
gggttaaaaattgatattcatgtcatcatcccttacgagggactcagtggttttcaaatgggtctgattgaaatgatc
ttcaaagttgtttacccagtggatgatcatcatttcaaggttattctccattatggtacactcgttattgaccggtgtg
acaccaaacatgattgactactttggacgcccttacgagggagctgtctgtgtttgacggcaagaagatcacagttact
ggaactctgtggaacggcaacaagatcattgatgagcgcctgatcaacccagatggttcactcctcttccgcgttact
atcaatggagtcaccggatggcgccttttgcgagcgtattcttgcc
```

SEQ ID NO: 27 (8A3 protein)
```
MVITLEDFVGDWRQTAGYNQDQVLEQGGVSSLFQKLGVSITPIQKIVLSGENGLKIDIHVIIPYEGLSGFQMGLIEMI
FKVVYPVDDHHFKVILHYGTLVIDGVTPNMIDYFGRPYEGIAVFDGKKITVTGTLWNGNKIIDERLINPDGSLLFRVT
INGVTGWRLCERILA
```

SEQ ID NO: 28 (Luc2 nucleotide)
```
atggaagatgccaaaaacattaagaagggcccagcgccattctacccactcgaagacgggaccgccggcgagcagctg
cacaaagccatgaagcgctacgccctggtgccggccaccatcgcctttaccgacgcacatatcgaggtggacattacc
tacgccgagtacttcgagatgagcgttcggctggcagaagctatgaagcgctatgggctgaatacaaaccatcggatc
gtggtgtgcagcgagaatagcttgcagttcttcatgccccgtgtgggtgccctgttcatcggtgtggctgtggcccca
gctaacgacatctacaacgagcgcgagctgctgaacagcatgggcatcagccagcccaccgtcgtattcgtgagcaag
aaaggcctgcaaaagatcctcaacgtgcaaaagaagctaccgatcatacaaaagatcatcatcatggatagcaagacc
gactaccagggcttccaaagcatgtacacttcgtgactccccatttgccaccgggcttcaaccgagtacgactctgtg
cccgagagcttcgaccgggacaaaaccatcgccctgatcatgaacagtagtggcagtaccggattgcccaagggcgta
gccctaccgcaccgcaccgcttgtgtccgattcagtcatgccccgcgaccccatcttcggcaaccagatcatccccgac
accgctatcctcagcgtggtgccatttcaccacgccgcttcggcatgttcaccacgctgggctacttgatctgcggctttt
cgggtcgtgctcatgtaccgcttcgaggaggagctattcttgcgcagcttgcaagactataagattcaatctgccctg
ctggtgcccacactatttagcttcttcgctaagagcactctcatcgacaagtacgacctaagcaacttgcacgagatc
gccagcggcggggcgccgctcagcaaggaggtaggtgaggccgtggccaaagcttccacctaccaggcatccgccag
ggctacggcctgacagaaacaaccagcgccattctgatcaccccgaaggggacgacaagcctggcgcagtaggcaag
gtggtgcccttcttcgaggctaaggtggtggacttggacaccgtaagacactgggtgtgaaccagcgcggcgagctg
tgcgtccgtggccccatgatcatgagcggctacgttaacaaccccgaggctacaaacgctctcatcgacaaggacggc
tggctgcacagcggcgacatcgcctactgggacgaggacgagcacttcttcatcgtggaccggctgaagagcctgatc
aaatacaagggctaccaggtagccccagccgaactggagagcatcctgctgcaacaccccaacatcttcgacgccggg
gtcgccggcctgcccgacgacgatgccggcgagctgcccgccgcagtcgtcgtgctggaacacggtaaaaccatgacc
gagaaggagatcgtggactatgtggccagccaggttacaaccgccaagaagctcgcggtggtgttgtgttcgtggac
gaggtgcctaaaggactgaccggcaagttggacgcccgcaagatccgcgagattctcattaaggccaagaagggcggc
aagatcgccgtt
```

SEQ ID NO: 29 (Luc2 protein)
```
medaknikkgpapfypledgtageqlhkamkryalvpgtiaftdahievdityaeyfemsvrlaeamkryglntnhri
vvcsenslqffmpvlgalfigvavapandiynerellnsmgisqptvvfvskkglqkilnvqkklpiiqkiiimdskt
dyqgfqsmytfvtshlppgfneydfvpesfdrdktialimnssgstglpkgvalphrtacvrfshardpifgnqiipd
tailsvvpfhhgfgmfttlgylicgfrvvlmyrfeeelflrslqdykiqsallvptlsffakstlidkydsnlhei
asggaplskevgeavakrfhlpgirqgygltettsailitpegddkpgavgkvvpffeakvvdldtgktlgvnqrgel
cvrgpmimsgyvnnpeatnalidkdgwlhsgdiaywdedehffivdrlkslikykgyqvapaelesillqhpnifdag
vaglpdddagelpaavvvlehgktmtekeivdyvasqvttakklrggvvfvdevpkgltgkldarkireilikakkgg
kiav
```

SEQ ID NO: 30 (HRL (Humanized Renilla) nucleotide)
```
Atggcttccaaggtgtacgaccccgagcaacgcaaacgcatgatcactgggcctcagtggtgggctcgctgcaagcaa
atgaacgtgctggactcctcatcaactactatgattccgagaagcacgccgagaacgccgtgatttttctgcatggt
aacgctgcctccagctacctgtggaggcacgtcgtgcctcacatcgagcccgtggctagatgcatcatccctgatctg
atcggaatgggtaagtccggcaagagcgggaatggctcatatcgcctcctggatcactacaagtacctcaccgcttgg
ttcgagctgctgaacctcccaaagaaaatcatctttgtgggccacgactgggggggcttgtctggccttttcactactcc
```

-continued

SEQUENCE LISTING

```
tacgagcaccaagacaagatcaaggccatcgtccatgctgagagtgtcgtggacgtgatcgagtcctgggacgagtgg
cctgacatcgaggaggatatcgccctgatcaagagcgaagagggcgagaaaatggtgcttgagaataacttcttcgtc
gagaccatgctcccaagcaagatcatgcggaaactggagcctgaggagttcgctgcctacctggagccattcaaggag
aagggcgaggttagacggcctaccctctcctggcctcgcgagatccctctcgttaagggaggcaagcccgacgtcgtc
cagattgtccgcaactacaacgctaccttcgggccagcgacgatctgcctaagatgttcatcgagtccgaccctggg
ttcttttccaacgctattgtcgagggagctaagaagttccctaacaccgagttcgtgaaggtgaagggcctccacttc
agccaggaggacgctccagatgaaatgggtaagtacatcaagagcttcgtggagcgcgtgctgaagaacgagcag
```

SEQ ID NO: 31 (HRL (Humanized Renilla) protein)
MASKVYDPEQRKRMITGPQWWARCKQMNVLDSFINYYDSEKHAENAVIFLHGNAASSYLWRHVVPHIEPVARCIIPDL
IGMGKSGKSGNGSYRLLDHYKYLTAWFELLNLPKKIIFVGHDWGACLAFHYSYEHQDKIKAIVHAESVVDVIESWDEW
PDIEEDIALIKSEEGEKMVLENNFFVETMLPSKIMRKLEPEEFAAYLEPFKEKGEVRRPTLSWPREIPLVKGGKPDVV
QIVRNYNAYLRASDDLPKMFIESDPGFFSNAIVEGAKKFPNTEFVKVKGLHFSQEDAPDEMGKYIKSFVERVLKNEQ SEQ ID NO: 32 (Id-HRL-HT7 sandwich fusion nucleotide)
```
atgcttggtctgtcggagcaaagcgtgtccatctcgcgctgcgctgggacggcgctgcccgccttgctggacgagcag
caggtgaacgtcctgctctacgacatgaacggctgctactcacgcctcaaggagctggtgcccaccctgccccagaac
cgcaaagtgagcaaggtggagatcctgcagcatgtaatcgactacatcagggacctgcagctggagctgaactcggag
tctgaagtcgggaccaccggaggccggggactgcctgtccgcgcccgctcagcaccctgaacggcgagatcagtgcc
ttggcggccgaggcggcatgtgttccagccgacgatcgcatcctgtcgcgtttctcttgagaatctttattttcag
gcgtctggaggtggtggcggagcgatcgccatggcttccaaggtgtacgaccccgagcaacgcaaacgcatgatcact
gggcctcagtggtgggctcgctgcaagcaaatgaacgtgctggactccttcatcaactactatgattccgagaagcac
gccgagaacgccgtgattttctgcatggtaacgctgcctccagctacctgtggaggcacgtcgtgcctcacatcgag
cccgtggctagatgcatcatccctgatctgatcggaatgggtaagtccggcaagagcgggaatggctcatatcgcctc
ctggatcactacaagtacctcaccgcttggttcgagctgctgaacttccaaagaaaatcatctttgtgggccacgac
tgggggcttgtctggcctttcactactcctacgagcaccaagacaagatcaaggccatcgtccatgctgagagtgtc
gtggacgtgatcgagtcctgggacgagtggcctgacatcgaggaggatatcgccctgatcaagagcgaagagggcgag
aaaatggtgcttgagaataacttcttcgtcgagaccatgctcccaagcaagatcatgcggaaactggagcctgaggag
ttcgctgcctacctggagccattcaaggagaagggcgaggttagacggcctaccctctcctggcctcgcgagatccct
ctcgttaagggaggcaagcccgacgtcgtccagattgtccgcaactacaacgctaccttcgggccagcgacgatctg
cctaagatgttcatcgagtccgaccctgggttcttttccaacgctattgtcgagggagctaagaagttccctaacacc
gagttcgtgaaggtgaagggcctccacttcagccaggaggacgctccagatgaaatgggtaagtacatcaagagcttc
gtggagcgcgtgctgaagaacgagcaggttttctctcgagccaaccactgaggatctgtactttcagagcgataacgat
ggatccgaaatcggtactggctttccattcgaccccattatgtggaagtcctgggcgagcgcatgcactacgtcgat
gttggtccgcgcgatggcacccctgtgctgttcctgcacggtaacccgacctcctcctacgtgtggcgcaacatcatc
ccgcatgttgcaccgacccatcgctgcattgctccagacctgatcggtatgggcaaatccgacaaaccagacctgggt
tattcttcgacgaccacgtccgcttcatggatgccttcatcgaagccctgggtctggaagaggtcgtcctggtcatt
cacgactggggctccgctctgggtttccactgggccaagcgcaatccagagcgcgtcaaaggtattgcatttatggag
ttcatccgcccatcccgacctgggacgaatggccagaatttgcccgcgagaccttccaggcttccgcaccaccgac
gtcggccgcaagctgatcatcgatcagaacgtttttatcgagggtacgctgccgatgggtgtcgtccgcccgctgact
gaagtcgagatggaccattaccgcgagccgttcctgaatcctgttgaccgcgagccactgtggcgcttcccaaacgag
ctgccaatcgccggtgagccagcgaacatcgtcgcgctggtcgaagaatacatggactggctgcaccagtccctgtc
ccgaagctgctgttctggggcacccaggcgttctgatcccaccggccgaagccgctcgcctggccaaaagctgcct
aactgcaaggctgtggacatcggcccgggtctgaatctgctgcaagaagacaacccggacctgatcggcagcgagatc
gcgcgctggctgtctactctggagatttccggt
```

SEQ ID NO: 33 (Id-HRL-HT7 sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGRGLPVRAPLSTLNGEISALAAEEAACVPADDRILCRVSLENLYFQASGGGGAIAMASKVYDPEQRKRMIT
GPQWWARCKQMNVLDSFINYYDSEKHAENAVIFLHGNAASSYLWRHVVPHIEPVARCIIPDLIGMGKSGKSGNGSYRL
LDHYKYLTAWFELLNLPKKIIFVGHDWGACLAFHYSYEHQDKIKAIVHAESVVDVIESWDEWPDIEEDIALIKSEEGE
KMVLENNFFVETMLPSKIMRKLEPEEFAAYLEPFKEKGEVRRPTLSWPREIPLVKGGKPDVVQIVRNYNAYLRASDDL
PKMFIESDPGFFSNAIVEGAKKFPNTEFVKVKGLHFSQEDAPDEMGKYIKSFVERVLKNEQVSLEPTTEDLYFQSDND
GSEIGTGFPFDPHYVEVLGERMHYVDVGPRDGTPVLFLHGNPTSSYVWRNIIPHVAPTHRCIAPDLIGMGKSDKPDLG
YFFDDHVRFMDAFIEALGLEEVVLVIHDWGSALGFHWAKRNPENVKGIAFMEFIRPIPTWDEWPEFARETFQAFRTTD
VGRKLIIDQNVFIEGTLPMGVVRPLTEVEMDHYREPFLNPVDREPLWRFPNELPIAGEPANIVALVEEYMDWLHQSPV
PKLLFWGTPGVLIPPAEAARLAKSLPNCKAVDIGPGLNLLQEDNPDLIGSEIARWLSTLEISG SEQ ID NO: 34 (8A3-HT7 fusion nucleotide)
```
atggtgattacattggaggatttcgttggagactggcggcagacagctggatacaaccaagatcaagtgttagaacaa
ggaggagtgtctagtctgttccaaaagctgggagtgtcaatcaccccaatccagaaaattgtgctgtctggggagaat
gggtaaaaattgatattcatgtcatcatcccttacgagggactcagtggttttcaaatgggtctgattgaaatgatc
ttcaaagttgtttacccagtggatgatcatcatttcaaggttattctccattatggtacactcgttattgacggtgtg
acaccaaacatgattgactactttggacgcccttacgagggaattgctgtgtttgacggcaagaagatcacagttact
ggaactctgtggaacggcaacaagatcattgatgagcgcctgatcaacccagatggtcactcctcttccgcgttact
atcaatggagtcaccggatggcgccttttgcgagcgtattcttgccggatatctcgagccaaccactgaggatctgtac
tttcagagcgataacgatggatccgaaatcggtactggctttccattcgaccccattatgtggaagtcctgggcgag
cgcatgcactacgtcgatgttggtccgcgcgatggcacccctgtgctgttcctgcacggtaacccgacctcctcctac
gtgtggcgcaacatcatcccgcatgttgcaccgacccatcgctgcattgctccagacctgatcggtatgggcaaatcc
gacaaaccagacctgggttattcttcgacgaccacgtccgcttcatggatgccttcatcgaagccctgggtctggaa
gaggtcgtcctggtcattcacgactggggctccgctctgggtttccactgggccaagcgcaatccagagcgcgtcaaa
ggtattgcatttatggagttcatccgcccatcccgacctgggacgaatggccagaatttgcccgcgagaccttccag
gcttccgcaccaccgacgtcggccgcaagctgatcatcgatcagaacgtttttatcgagggtacgctgccgatggt
gtcgtccgcccgctgactgaagtcgagatggaccattaccgcgagccgttcctgaatcctgttgaccgcgagccactg
tggcgcttcccaaacgagctgccaatcgccggtgagccagcgaacatcgtcgcgctggtcgaagaatacatggactgg
ctgcaccagtcccctgtcccgaagctgctgttctggggcacccaggcgttctgatcccaccggccgaagccgctcgc
```

```
ctggccaaaagcctgcctaactgcaaggctgtggacatcggcccgggtctgaatctgctgcaagaagacaacccggac
ctgatcggcagcgagatcgcgcgctggctgtctactctggagatttccggt
```

SEQ ID NO: 35 (8A3-HT7 fusion protein)
MVITLEDFVGDWRQTAGYNQDQVLEQGGVSSLFQKLGVSITPIQKIVLSGENGLKIDIHVIIPYEGLSGFQMGLIEMI
FKVVYPVDDHHFKVILHYGTLVIDGVTPNMIDYFGRPYEGIAVFDGKKITVTGTLWNGNKIIDERLINPDGSLLFRVT
INGVTGWRLCERILAGYLEPTTEDLYFQSDNDGSEIGTGFPPFDPHYVEVLGERMHYVDVGPRDGTPVLFLHGNPTSSY
VWRNIIPHVAPTHRCIAPDLIGMGKSDKPDLGYFFDDHVRFMDAFIEALGLEEVVLVIHDWGSALGFHWAKRNPERVK
GIAFMEFIRPIPTWDEWPEFARETFQAFRTTDVGRKLIIDQNVFIEGTLPMGVVRPLTEVEMDHYREPFLNPVDREPL
WRFPNELPIAGEPANIVALVEEYMDWLHQSPVPKLLFWGTPGVLIPPAEAARLAKSLPNCKAVDIGPGLNLLQEDNPD
LIGSEIARWLSTLEISG SEQ ID NO: 36 (9B8-HT7 fusion nucleotide)
```
atggtgtttacattggaggatttcgttggagactggcggcagacagctggatacaacctagatcaagtgttagaacaa
ggaggattgtctagtctgttccaaaagctgggagtgtcagtcaccccaatccagaaaattgtgctgtctggggagaat
gggttaaaaattgatattcatgtcatcatcccttacgagggactcagtggttatcaaatgggtcagattgaaaagatc
ttcaaagttgtttaccccagtggatgatcatcatttcaaggttattctccattatggtacactcgttattgacggtgtg
acaccaaacatgattgactactttggacgcccttacgagggaattgctgtgtttgacggcaagaagatcacagttact
ggaactctgtggaacggcaacaagatcattgatgagcgcctgatcaacccagatggttcactcctcttccgcgttact
atcaatggagtcaccggatggcgcctttgcgagcgtattcttgccggatatctcgagccaaccactgaggatctgtac
tttcagagcgataacgatggatccgaaatcggtactggctttccattcgaccccattatgtggaagtcctgggcgag
cgcatgcactacgtcgatgttggtccgcgcgatggcacccctgtgctgttcctgcacggtaacccgacctcctcctac
gtgtggcgcaacatcatcccgcatgttgcaccgacccatcgctgcattgctccagacctgatcggtatgggcaaatcc
gacaaaccagacctgggttatttcttcgacgaccacgtccgcttcatggatgccttcatcgaagccctgggtctggaa
gaggtcgtcctggtcattcacgactgggctccgctctgggtttccactgggccaagcgcaatccagagcgcgtcaaa
ggtattgcatttatggagttcatccgccctatcccgacctgggacgaatggccagaatttgcccgcgagaccttccag
gccttccgcaccaccgacgtcggccgcaagctgatcatcgatcagaacgttttttatcgagggtacgctgccgatggt
gtcgtccgcccgctgactgaagtcgagatggaccattaccgcgagccgttcctgaacctgttgaccgcgagccactg
tggcgcttcccaaacgagctgccaatcgccggtgagccagcgaacatcgtcgcgctggtcgaagaatacatggactgg
ctgcaccagtcccctgtcccgaagctgctgttctggggcacccaggcgttctgatcccaccggccgaagccgctcgc
ctggccaaaagcctgcctaactgcaaggctgtggacatcggcccgggtctgaatctgctgcaagaagacaacccggac
ctgatcggcagcgagatcgcgcgctggctgtctactctggagatttccggt
```

SEQ ID NO: 37 (9B8-HT7 fusion protein)
MVFTLEDFVGDWRQTAGYNLDQVLEQGGLSSLFQKLGVSVTPIQKIVLSGENGLKIDIHVIIPYEGLSGYQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILAGYLEPTTEDLYFQSDNDGSEIGTGFPPFDPHYVEVLGERMHYVDVGPRDGTPVLFLHGNPTSSY
VWRNIIPHVAPTHRCIAPDLIGMGKSDKPDLGYFFDDHVRFMDAFIEALGLEEVVLVIHDWGSALGFHWAKRNPERVK
GIAFMEFIRPIPTWDEWPEFARETFQAFRTTDVGRKLIIDQNVFIEGTLPMGVVRPLTEVEMDHYREPFLNPVDREPL
WRFPNELPIAGEPANIVALVEEYMDWLHQSPVPKLLFWGTPGVLIPPAEAARLAKSLPNCKAVDIGPGLNLLQEDNPD
LIGSEIARWLSTLEISG SEQ ID NO: 38 (9F6-HT7 fusion nucleotide)
```
atggtgtttacattggaggatttcgttggagactggcggcagacagctggatacaacctagatcaagtgttagaacaa
ggaggagtgtctagtctgttccaaaagctgggagtgtcaatcaccccaatccagaaaattgtgctgtctggggagaat
gggttaaaaattgatattcatgtcatcatcccttacgagggactcagtggttatcaaatgggtcagattgaaaagatc
ttcaaagttgtttaccccagtggatgatcatcatttcaaggttattctccattatggtacactcgttattgacggtgtg
acaccaaacatgattgactactttggacgcccttacgagggaattgctgtgtttgacggcaagaagatcacagttact
ggaactctgtggaacggcaacaagatcattgatgagcgcctgatcaacccagatggttcactcctcttccgcgttact
atcaatggagtcaccggatggcgcctttgcgagcgtattcttgccggatatctcgagccaaccactgaggatctgtac
tttcagagcgataacgatggatccgaaatcggtactggctttccattcgaccccattatgtggaagtcctgggcgag
cgcatgcactacgtcgatgttggtccgcgcgatggcacccctgtgctgttcctgcacggtaacccgacctcctcctac
gtgtggcgcaacatcatcccgcatgttgcaccgacccatcgctgcattgctccagacctgatcggtatgggcaaatcc
gacaaaccagacctgggttatttcttcgacgaccacgtccgcttcatggatgccttcatcgaagccctgggtctggaa
gaggtcgtcctggtcattcacgactgggctccgctctgggtttccactgggccaagcgcaatccagagcgcgtcaaa
ggtattgcatttatggagttcatccgccctatcccgacctgggacgaatggccagaatttgcccgcgagaccttccag
gccttccgcaccaccgacgtcggccgcaagctgatcatcgatcagaacgttttttatcgagggtacgctgccgatggt
gtcgtccgcccgctgactgaagtcgagatggaccattaccgcgagccgttcctgaacctgttgaccgcgagccactg
tggcgcttcccaaacgagctgccaatcgccggtgagccagcgaacatcgtcgcgctggtcgaagaatacatggactgg
ctgcaccagtcccctgtcccgaagctgctgttctggggcacccaggcgttctgatcccaccggccgaagccgctcgc
ctggccaaaagcctgcctaactgcaaggctgtggacatcggcccgggtctgaatctgctgcaagaagacaacccggac
ctgatcggcagcgagatcgcgcgctggctgtctactctggagatttccggt
```

SEQ ID NO: 39 (9F6-HT7 fusion protein)
MVFTLEDFVGDWRQTAGYNLDQVLEQGGVSSLFQKLGVSITPIQKIVLSGENGLKIDIHVIIPYEGLSGYQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILAGYLEPTTEDLYFQSDNDGSEIGTGFPPFDPHYVEVLGERMHYVDVGPRDGTPVLFLHGNPTSSY
VWRNIIPHVAPTHRCIAPDLIGMGKSDKPDLGYFFDDHVRFMDAFIEALGLEEVVLVIHDWGSALGFHWAKRNPERVK
GIAFMEFIRPIPTWDEWPEFARETFQAFRTTDVGRKLIIDQNVFIEGTLPMGVVRPLTEVEMDHYREPFLNPVDREPL
WRFPNELPIAGEPANIVALVEEYMDWLHQSPVPKLLFWGTPGVLIPPAEAARLAKSLPNCKAVDIGPGLNLLQEDNPD
LIGSEIARWLSTLEISG SEQ ID NO: 40 (Id-9B8 opt-HT7 sandwich fusion nucleotide)
```
atgcttggtctgtcggagcaaagcgtgtccatctcgcgctgcgctgggacgcgcctgccgccttgctggacgagcag
caggtgaacgtcctgctctacgacatgaacggctgctactcacgcctcaaggagctggtgcccaccctgccccagaac
cgcaaagtgagcaaggtggagatcctgcagcatgtaatcgactacatcagggacctgcagctggagctgaactcggag
tctgaagtcgggaccaccgggaggccgggactgcctgtccgcgccccgctcagcaccctgaacggcgagatcagtgcc
```

-continued

SEQUENCE LISTING

```
ttggcggccgaggcggcatgtgttccagccgacgatcgcatcttgtgtcgcgtttctcttgagaatctttattttcag
gcgtctggaggtggtggcgagcgatcgccatggtgtttacactcgaagatttcgtaggggactggcggcagacagcc
ggctacaacctggaccaagtccttgagcagggcggtctgtccagtttgtttcagaaactcggggtgtccgtaacaccg
atccaaaagattgtcctgagcggtgaaaacggcctgaagatcgacatccatgtcatcatcccgtatgaaggtctgagc
ggctatcagatgggccagatcgaaaaaattttttaaggtggtgtaccctgtggatgatcatcactttaaggtgattctg
cactatggcacactggtaatcgacggggttacgccgaacatgatcgactatttcggacggccgtatgaaggcatcgcc
gtgttcgacggcaaaaagatcactgtaaccgggacccctgtggaacggcaacaaaattatcgacgagcgcctgatcaac
cccgacggctccctgctgttccgcgtaaccatcaacggagtgaccggctggcggctgtgcgagcgtattcttgccgga
tatctcgagccaaccactgaggatctgtactttcagagcgataacgatggatccgaaatcggtactggcttttccattc
gaccccattatgtggaagtcctgggcgagcgcatgcactacgtcgatgttggtccgcgcgatggcacccctgtgctg
ttcctgcacggtaacccgacctcctcctacgtgtggcgcaacatcatcccgcatgttgcaccgacccatcgctgcatt
gctccagacctgatcggtatgggcaaatccgacaaaccagaactgggttatttcttcgacgaccacgtccgcttcatg
gatgccttcatcgaagccctgggtctggaagaggtcgtcctggtcattcacgactggggctccgctctgggtttccac
tgggccaagcgcaatccagagcgcgtcaaaggtattgcatttatggagttcatccgccctatcccgacctgggacgaa
tggccagaatttgcccgcgagaccttccaggccttccgcaccaccgacgtcggccgcaagctgatcatcgatcagaac
gttttttatcgaggggtacgctgccgatgggtgtcgtccgcccgctgactgaagtcgagatggaccattaccgcgagccg
ttcctgaatcctgttgaccgcgagccactgtggcgcttcccaaacgagctgccaatcgccggtgagccagcgaacatc
gtccgcgtggtcgaagaatacatggactggctgcaccagtccctgtcccgaagctgctgttctggggcacccaggc
gttctgatcccaccggccgaagccgctcgcctggccaaaagcctgcctaactgcaaggctgtggacatcggcccgggt
ctgaatctgctgcaagaagacaacccggacctgatcggcagcgagatcgcgcgctggctgtctactctggagatttcc
ggtt
```

SEQ ID NO: 41 (Id-9B8 opt-HT7 sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGGRGLPVRAPLSTLNGEISALAAEEAACVPADDRILCRVSLENLYFQASGGGGGAIAMVFTLEDFVGDWRQTA
GYNLDQVLEQGGLSSLFQKLGVSVTPIQKIVLSGENGLKIDIHVIIPYEGLSGYQMGQIEKIFKVVYPVDDHHFKVIL
HYGTLVIDGVTPNMIDYFGRPYEGIAVFDGKKITVTGTLWNGNKIIDERLINPDGSLLFRVTINGVTGWRLCERILAG
YLEPTTEDLYFQSDNDGSEIGTGFPFDPHYVEVLGERMHYVDVGPRDGTPVLFLHGNPTSSYVWRNIIPHVAPTHRCI
APDLIGMGKSDKPDLGYFFDDHVRFMDAFIEALGLEEVVLVIHDWGSALGFHWAKRNPERVKGIAFMEFIRPIPTWDE
WPEFARETFQAFRTTDVGRKLIIDQNVFIEGTLPMGVVRPLTEVEMDHYREPFLNPVDREPLWRFPNELPIAGEPANI
VALVEEYMDWLHQSPVPKLLFWGTPGVLIPPAEAARLAKSLPNCKAVDIGPGLNLLQEDNPDLIGSEIARWLSTLEIS
G SEQ ID NO: 42 (9B8 opt+K33N nucleotide)
Atggtgtttacactcgaagatttcgtaggggactggcggcagacagccggctacaacctggaccaagtccttgagcag
ggcggtctgtccagtttgtttcagaatctcggggtgtccgtaacaccgatccaaaagattgtcctgagcggtgaaaac
ggcctgaagatcgacatccatgtcatcatcccgtatgaaggtctgagcggctatcagatgggccagatcgaaaaaatt
tttaaggtggtgtaccctgtggatgatcatcactttaaggtgattctgcactatggcacactggtaatcgacggggtt
acgccgaacatgatcgactatttcggacggccgtatgaaggcatcgccgtgttcgacggcaaaaagatcactgtaacc
gggaccctgtggaacggcaacaaaattatcgacgagcgcctgatcaaccccgacggctccctgctgttccgcgtaacc
atcaacggagtgaccggctggcggctgtgcgagcgcattttggcg SEQ ID NO: 43 (9B8 opt+K33N protein)
MVFTLEDFVGDWRQTAGYNLDQVLEQGGLSSLFQNLGVSVTPIQKIVLSGENGLKIDIHVIIPYEGLSGYQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILA SEQ ID NO: 44 (QC27-HT7 nucleotide)
atggtgtttacattggaaggatttcgttggagactggcggcagacagctggatacaacctagatcaagtgttagaacaa
ggaggattgtctagtctgttccaaaagctgggagtgtcagtcaccccaatccagaaaattgtgctgtctggggagaat
gggttaaaaattgatattcatgtcatcatcccttacgagggactcagtggttttcaaatgggtctgattgaaatgatc
ttcaaagttgtttaccccagtggatgatcatcatttcaagattattcaccattatggtacactcgttattgacggtgtg
acaccaaacatgattgacttctttggacgccctacgagggaattgctgtgtttgacggcaagaagatcacagttact
ggaactctgtggaacggcaacaagatcattgatgagcgcctgatcaacccagatggttcactcctcttccgcgttact
atcaatggagtcaccggatggcgcctttgcgagcgtattcttgccggatatctcgagccaaccactgaggatctgtac
tttcagagcgataacgatggatccgaaatcggtactggcttttccattcgaccccattatgtggaagtcctgggcgag
cgcatgcactacgtcgatgttggtccgcgcgatggcacccctgtgctgttcctgcacggtaaccgacctcctcctac
gtgtggcgcaacatcatcccgcatgttgcaccgacccatcgctgcattgcctccagacctgatcggtatgggcaaatcc
gacaaaccagacctgggttatttcttcgacgaccacgtccgcttcatggatgccttcatcgaagccctgggtctggaa
gaggtcgtcctggtcattcacgactggggctccgctctgggtttccactgggccaagcgcaatccagagcgcgtcaaa
ggtattgcatttatggagttcatccgccctatcccgacctgggacgaatggccagaatttgcccgcgagaccttccag
gccttccgcaccaccgacgtcggccgcaagctgatcatcgatcagaacgtttttatcgagggtacgctgccgatgggt
gtcgtccgccgctgactgaagtcgagatggaccattaccgcgagccgttcctgaatcctgttgaccgcgagccactg
tggcgcttcccaaacgagctgccaatcgccggtgagccagcgaacatcgtccgcgtggtcgaagaatacatggactgg
ctgcaccagtcccctgtcccgaagctgctgttctggggcacccaggcgttctgatcccaccggccgaagccgctcgc
ctggccaaaagcctgcctaactgcaaggctgtggacatcggcccgggtctgaatctgctgcaagaagacaacccggac
ctgatcggcagcgagatcgcgcgctggctgtctactctggagatttccggt SEQ ID NO: 45 (QC27-HT7 protein)
MVFTLEDFVGDWRQTAGYNLDQVLEQGGLSSLFQKLGVSVTPIQKIVLSGENGLKIDIHVIIPYEGLSGFQMGLIEMI
FKVVYPVDDHHFKIIHHYGTLVIDGVTPNMIDFFGRPYEGIAVFDGKKITVTGTLWNGNKIIDERLINPDGSLLFRVT
INGVTGWRLCERILAGYLEPTTEDLYFQSDNDGSEIGTGFPFDPHYVEVLGERMHYVDVGPRDGTPVLFLHGNPTSSY
VWRNIIPHVAPTHRCIAPDLIGMGKSDKPDLGYFFDDHVRFMDAFIEALGLEEVVLVIHDWGSALGFHWAKRNPERVK
GIAFMEFIRPIPTWDEWPEFARETFQAFRTTDVGRKLIIDQNVFIEGTLPMGVVRPLTEVEMDHYREPFLNPVDREPL
WRFPNELPIAGEPANIVALVEEYMDWLHQSPVPKLLFWGTPGVLIPPAEAARLAKSLPNCKAVDIGPGLNLLQEDNPD
LIGSEIARWLSTLEISG

SEQUENCE LISTING

```
SEQ ID NO: 46 (8F2)
atggtgtttacattggaggatttcgttggagactggcggcagacagctggatacaaccaagatcaagtgttagaacaa
ggaggagtgtctagtctgttccaaaagctgggagtgtcagtcaccccaatccagaaaattgtgctgtctggggagaat
gggttaaaaattgatattcatgtcatcatcccttacgagggactcagtggttttcaaatgggtctgattgaaatgatc
ttcaaagttgtttacccagtggatgatcatcatttcaaggttattctccattatggtacactcgttattgacggtgtg
acaccaaacatgattgactactttggacgcccttacgagggaattgctgtgtttgacggcaagaagatcacagttact
ggaactctgtggaacggcaacaagatcattgatgagcgcctgatcaacccagatggttcactcctcttccgcgttact
atcaatggagtcaccggatggcgcctttgcgagcgtattcttgcc SEQ ID NO: 47 (8F2 protein)
MVFTLEDFVGDWRQTAGYNQDQVLEQGGVSSLFQKLGVSVTPIQKIVLSGENGLKIDIHVIIPYEGLSGFQMGLIEMI
FKVVYPVDDHHFKVILHYGTLVIDGVTPNMIDYFGRPYEGIAVFDGKKITVTGTLWNGNKIIDERLINPDGSLLFRVT
INGVTGWRLCERILA SEQ ID NO: 48 (IV-HT7 nucleotide)
atggtgtttacattggaggatttcgttggagactggcggcagacagctggatacaaccaagatcaagtgttagaacaa
ggaggattgtctagtctgttccaaaagctgggagtgtcagtcaccccaatccagaaaattgtgctgtctggggagaat
gggttaaaaattgatattcatgtcatcatcccttacgagggactcagtggttttcaaatgggtctgattgaaatgatc
ttcaaagttgtttacccagtggatgatcatcatttcaaggttattctccattatggtacactcgttattgacggtgtg
acaccaaacatgattgactactttggacgcccttacgagggaattgctgtgtttgacggcaagaagatcacagttact
ggaactctgtggaacggcaacaagatcattgatgagcgcctgatcaacccagatggttcactcctcttccgcgttact
atcaatggagtcaccggatggcgcctttgcgagcgtattcttgccggatatctcgagccaaccactgaggatctgtac
tttcagagcgataacgatggatccgaaatcggtactggctttccattcgaccccattatgtggaagtcctgggcgag
cgcatgcactacgtcgatgttggtccgcgcgatggcacccctgtgctgttcctgcacggtaacccgacctcctcctac
gtgtggcgcaacatcatcccgcatgttgcaccgacccatcgctgcattgctccagacctgatcggtatgggcaaatcc
gacaaaccagacctgggttatttcttcgacgaccacgtccgcttcatggatgccttcatcgaagccctgggtctggaa
gaggtcgtcctggtcattcacgactggggctccgctctgggtttccactgggccaagcgcaatccagagcgcgtcaaa
ggtattgcatttatggagttcatccgccctatcccgacctgggacgaatggccagaatttgcccgcgagaccttccag
gccttccgcaccaccgacgtcggccgcaagctgatcatcgatcagaacgtttttatcgagggtacgctgccgatggt
gtcgtccgcccgctgactgaagtcgagatggaccattaccgcgagccgttcctgaatcctgttgaccgcgagccactg
tggcgcttcccaaacgagctgccaatcgccggtgagccagcgaacatcgtcgcgctggtcgaagaatacatggactgg
ctgcaccagtccctgtcccgaagctgctgttctggggcaccccaggcgttctgatcccaccggccgaagccgctcgc
ctggccaaaagcctgcctaactgcaaggctgtggacatcggcccgggtctgaatctgctgcaagaagacaacccggac
ctgatcggcagcgagatcgcgcgctggctgtctactctggagatttccggt SEQ ID NO: 49 (IV-HT7 protein)
MVFTLEDFVGDWRQTAGYNQDQVLEQGGLSSLFQKLGVSVTPIQKIVLSGENGLKIDIHVIIPYEGLSGFQMGLIEMI
FKVVYPVDDHHFKVILHYGTLVIDGVTPNMIDYFGRPYEGIAVFDGKKITVTGTLWNGNKIIDERLINPDGSLLFRVT
INGVTGWRLCERILAGYLEPTTEDLYFQSDNDGSEIGTGFPFDPHYVEVLGERMHYVDVGPRDGTPVLFLHGNPTSSY
VWRNIIPHVAPTHRCIAPDLIGMGKSDKPDLGYFFDDHVRFMDAFIEALGLEEVVLVIHDWGSALGFHWAKRNPERVK
GIAFMEFIRPIPTWDEWPEFARETFQAFRTTDVGRKLIIDQNVFIEGTLPMGVVRPLTEVEMDHYREPFLNPVDREPL
WRFPNELPIAGEPANIVALVEEYMDWLHQSPVPKLLFWGTPGVLIPPAEAARLAKSLPNCKAVDIGPGLNLLQEDNPD
LIGSEIARWLSTLEISG SEQ ID NO: 50 (8F2-HT7 nucleotide)
atggtgtttacattggaggatttcgttggagactggcggcagacagctggatacaaccaagatcaagtgttagaacaa
ggaggagtgtctagtctgttccaaaagctgggagtgtcagtcaccccaatccagaaaattgtgctgtctggggagaat
gggttaaaaattgatattcatgtcatcatcccttacgagggactcagtggttttcaaatgggtctgattgaaatgatc
ttcaaagttgtttacccagtggatgatcatcatttcaaggttattctccattatggtacactcgttattgacggtgtg
acaccaaacatgattgactactttggacgcccttacgagggaattgctgtgtttgacggcaagaagatcacagttact
ggaactctgtggaacggcaacaagatcattgatgagcgcctgatcaacccagatggttcactcctcttccgcgttact
atcaatggagtcaccggatggcgcctttgcgagcgtattcttgccggatatctcgagccaaccactgaggatctgtac
tttcagagcgataacgatggatccgaaatcggtactggctttccattcgaccccattatgtggaagtcctgggcgag
cgcatgcactacgtcgatgttggtccgcgcgatggcacccctgtgctgttcctgcacgtaacccgacctcctcctac
gtgtggcgcaacatcatcccgcatgttgcaccgacccatcgctgcattgctccagacctgatcggtatgggcaaatcc
gacaaaccagacctgggttatttcttcgacgaccacgtccgcttcatggatgccttcatcgaagccctgggtctggaa
gaggtcgtcctggtcattcacgactggggctccgctctgggtttccactgggccaagcgcaatccagagcgcgtcaaa
ggtattgcatttatggagttcatccgccctatcccgacctgggacgaatggccagaatttgcccgcgagaccttccag
gccttccgcaccaccgacgtcggccgcaagctgatcatcgatcagaacgtttttatcgagggtacgctgccgatggt
gtcgtccgcccgctgactgaagtcgagatggaccattaccgcgagccgttcctgaatcctgttgaccgcgagccactg
tggcgcttcccaaacgagctgccaatcgccggtgagccagcgaacatcgtcgcgctggtcgaagaatacatggactgg
ctgcaccagtccctgtcccgaagctgctgttctggggcaccccaggcgttctgatcccaccggccgaagccgctcgc
ctggccaaaagcctgcctaactgcaaggctgtggacatcggcccgggtctgaatctgctgcaagaagacaacccggac
ctgatcggcagcgagatcgcgcgctggctgtctactctggagatttccggt SEQ ID NO: 51 (8F2-HT7 protein)
MVFTLEDFVGDWRQTAGYNQDQVLEQGGVSSLFQKLGVSVTPIQKIVLSGENGLKIDIHVIIPYEGLSGFQMGLIEMI
FKVVYPVDDHHFKVILHYGTLVIDGVTPNMIDYFGRPYEGIAVFDGKKITVTGTLWNGNKIIDERLINPDGSLLFRVT
INGVTGWRLCERILAGYLEPTTEDLYFQSDNDGSEIGTGFPFDPHYVEVLGERMHYVDVGPRDGTPVLFLHGNPTSSY
VWRNIIPHVAPTHRCIAPDLIGMGKSDKPDLGYFFDDHVRFMDAFIEALGLEEVVLVIHDWGSALGFHWAKRNPERVK
GIAFMEFIRPIPTWDEWPEFARETFQAFRTTDVGRKLIIDQNVFIEGTLPMGVVRPLTEVEMDHYREPFLNPVDREPL
WRFPNELPIAGEPANIVALVEEYMDWLHQSPVPKLLFWGTPGVLIPPAEAARLAKSLPNCKAVDIGPGLNLLQEDNPD
LIGSEIARWLSTLEISG SEQ ID NO: 52 (15C1-HT7 nucleotide)
atggtgtttacattgaaggatttcgttggagactggcggcagacagctggatacaaccaagatcaagtgttagaacaa
ggaggattgtctagtctgttccaaaatctgggagtgtcagtcaccccaatccagaaaattgtgctgtctggggagaat
```

-continued

SEQUENCE LISTING

```
gggttaaaaattgatattcatgtcatcatcccttacgagggactcagtggttatcaaatgggtcagattgaaaagatc
ttcaaagttgtttacccagtggatgatcatcatttcaaggttattctccattatggtacactcgttattgacggtgtg
acaccaaacatgattgactactttggacgccct tacgagggaattgctgtgttgactggcaagaagatcacagttact
ggaactctgtggaacggcaacaagatcattgatgagcgcctgatcaacccagatggttcactcctcttccgcgttact
atcaatggagtcaccggatggcgcctttgcgagcgtattcttgccggatatctcgagccaaccactgaggatctgtac
tttcagagcgataacgatggatccgaaatcggtactggctttccattcgaccccattatgtggaagtcctgggcgag
cgcatgcactacgtcgatgttggtccgcgcgatggcaccctgtgctgttcctgcacggtaacccgacctcctcctac
gtgtggcgcaacatcatcccgcatgttgcaccgacccatcgctgcattgctccagacctgatcggtatgggcaaatcc
gacaaaccagacctgggttatttcttcgacgaccacgtccgcttcatggatgccttcatcgaagccctgggtctggaa
gaggtcgtcctggtcattcacgactggggctccgctctgggtttccactgggccaagcgcaatccagagcgcgtcaaa
ggtattgcatttatggagttcatccgccctatcccgacctgggacgaatggccagaatttgcccgcgagaccttccag
gccttccgcaccaccgacgtcggccgcaagctgatcatcgatcagaacgttttt atcgagggtacgctgccgatgggt
gtcgtccgcccgctgactgaagtcgagatggaccattaccgcgagccgttcctgaatcctgttgaccgcgagcactg
tggcgcttcccaaacgagctgccaatcgccggtgagccagcgaacatcgtcgcgctggtcgaagaatacatggactgg
ctgcaccagtccctgtcccgaagctgctgttctggggcaccccaggcgttctgatcccaccggccgaagccgctcgc
ctggccaaaagcctgcctaactgcaaggctgtggacatcggcccgggtctgaatctgctgcaagaagacaacccggac
ctgatcggcagcgagatcgcgcgctggctgtctactctggagatttccggt
```

SEQ ID NO: 53 (15C1-HT7 protein)

MVFTLKDFVGDWRQTAGYNQDQVLEQGGLSSLFQNLGVSVTPIQKIVLSGENGLKIDIHVIIPYEGLSGYQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILAGYLEPTTEDLYFQSDNDGSEIGTGFPPDPHYVEVLGERMHYVDVGPRDGTPVLFLHGNPTSSY
VWRNIIPHVAPTHRCIAPDLIGMGKSDKPDLGYFFDDHVRFMDAFIEALGLEEVVLVIHDWGSALGFHWAKRNPERVK
GIAFMEFIRPIPTWDEWPEFARETFQAFRTTDVGRKLIIDQNVFIEGTLPMGVVRPLTEVEMDHYREPFLNPVDREPL
WRFPNELPIAGEPANIVALVEEYMDWLHQSPVPKLLFWGTPGVLIPPAEAARLAKSLPNCKAVDIGPGLNLLQEDNPD
LIGSEIARWLSTLEISG

SEQ ID NO: 54 (OgLuc Secretion Signal Peptide) Oplophorus gracilirostris
atggcttactccacactgttcatcattgctctcacagccgtcgtaacacaagcctcctccacacagaaaagcaacctg
aca SEQ ID NO: 55 (Id-C1A4E-HT7 sandwich fusion nucleotide)
```
atgcttggtctgtcggagcaaagcgtgtccatctcgcgctgcgctgggacgcgcctgcccgccttgctggacgagcag
caggtgaacgtcctgctctacgacatgaacggctgctactcacgcctcaaggagctggtgcccaccctgccccagaac
cgcaaagtgagcaaggtggagatcctgcagcatgtaatcgactacatcagggacctgcagctggagctgaactcggag
tctgaagtcgggaccaccggaggccggggactgcctgtccgcgccccgctcagcaccctgaacggcgagatcagtgcc
ttggcggccgaggcggcatgtgttccagccgacgatcgcatcttgtgtcgcgtttctcttgagaatctttattttcag
gcgtctggaggtggtggcggagcgatcgccatggtgtttacattggaggattt cgttggagactggcggcagacagct
ggatacaaccaagatcaagtgttagaacaaggaggattgtctagtctgttccaaaagctgggagtgtcagtcacccca
atccagaaaattgtgctgtctggggagaatgggttaaaatttgatattcatgtcatcatcccttacgagggactcagt
ggttttcaaatgggtctgattgaaatgatcttcaaagttgtttacccagtggatgatcatcatttcaagattattctc
cattatggtacactcgttattgacggtgtgacaccaaacatgattgactactttggacgcccttacgagggaattgct
gtgtttgacggcaagaagatcacagttactggaactctgtggaacggcaacaagatcattgatgagcgcctgatcaac
ccagatggttcactcctcttccgcgttactatcaatggagtcaccggatggcgcctttgcgagcgtattcttgccgga
tctctcgagccaaccactgaggatctgtactttcagagcgataacgatggatccgaaatcggtactggctttccattc
gaccccattatgtggaagtcctgggcgagcgcatgcactacgtcgatgttggtccgcgcgatggcaccccctgtgctg
ttcctgcacggtaacccgacctcctcctacgtgtggcgcaacatcatcccgcatgttgcaccgacccatcgctgcatt
gctccagacctgatcggtatgggcaaatccgacaaaccagacctgggttatttcttcgacgaccacgtccgcttcatg
gatgccttcatcgaagccctgggtctggaagaggtcgtcctggtcattcacgactggggctccgctctgggtttccac
tgggccaagcgcaatccagagcgcgtcaaaggtattgcatttatggagttcatccgccctatcccgacctgggacgaa
tggccagaatttgcccgcgagaccttccaggccttccgcaccaccgacgtcggccgcaagctgatcatcgatcagaac
gtttttatcgagggtacgctgccgatgggtgtcgtccgcccgctgactgaagtcgagatggaccattaccgcgagccg
ttcctgaatcctgttgaccgcgagcactgtggcgcttcccaaacgagctgccaatcgccggtgagccagcgaacatc
gtcgcgctggtcgaagaatacatggactggctgcaccagtccctgtcccgaagctgctgttctggggcaccccaggc
gttctgatcccaccggccgaagccgctcgcctggccaaaagcctgcctaactgcaaggctgtggacatcggcccgggt
ctgaatctgctgcaagaagacaacccggacctgatcggcagcgagatcgcgcgctggctgtctactctggagatttcc
ggt
```

SEQ ID NO: 56 (Id-C1A4E-HT7 sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGGRGLPVRAPLSTLNGEISALAAEEACVPADDRILCRVSLENLYFQASGGGGGAIAMVFTLEDFVGDWRQTA
GYNQDQVLEQGGLSSLFQKLGVSVTPIQKIVLSGENGLKFDIHVIIPYEGLSGFQMGLIEMIFKVVYPVDDHHFKIIL
HYGTLVIDGVTPNMIDYFGRPYEGIAVFDGKKITVTGTLWNGNKIIDERLINPDGSLLFRVTINGVTGWRLCERILAG
SLEPTTEDLYFQSDNDGSEIGTGFPPDPHYVEVLGERMHYVDVGPRDGTPVLFLHGNPTSSYVWRNIIPHVAPTHRCI
APDLIGMGKSDKPDLGYFFDDHVRFMDAFIEALGLEEVVLVIHDWGSALGFHWAKRNPERVKGIAFMEFIRPIPTWDE
WPEFARETFQAFRTTDVGRKLIIDQNVFIEGTLPMGVVRPLTEVEMDHYREPFLNPVDREPLWRFPNELPIAGEPANI
VALVEEYMDWLHQSPVPKLLFWGTPGVLIPPAEAARLAKSLPNCKAVDIGPGLNLLQEDNPDLIGSEIARWLSTLEIS
G SEQ ID NO: 57 (Id-IV-HT7 sandwich fusion nucleotide)
```
atgcttggtctgtcggagcaaagcgtgtccatctcgcgctgcgctgggacgcgcctgcccgccttgctggacgagcag
caggtgaacgtcctgctctacgacatgaacggctgctactcacgcctcaaggagctggtgcccaccctgccccagaac
cgcaaagtgagcaaggtggagatcctgcagcatgtaatcgactacatcagggacctgcagctggagctgaactcggag
tctgaagtcgggaccaccggaggccggggactgcctgtccgcgccccgctcagcaccctgaacggcgagatcagtgcc
ttggcggccgaggcggcatgtgttccagccgacgatcgcatcttgtgtcgcgtttctcttgagaatctttattttcag
gcgtctggaggtggtggcggagcgatcgccatggtgtttacattggaggattt cgttggagactggcggcagacagct
ggatacaaccaagatcaagtgttagaacaaggaggattgtctagtctgttccaaaagctgggagtgtcagtcacccca
```

```
atccagaaaattgtgctgtctggggagaatgggttaaaaattgatattcatgtcatcatcccttacgagggactcagt
ggttttcaaatgggtctgattgaaatgatcttcaaagttgtttacccagtggatgatcatcatttcaaggttattctc
cattatggtacactcgttattgacggtgtgacaccaaacatgattgactactttggacgccctacgagggaatttgct
gtgtttgacggcaagaagatcacagttactggaactctgtggaacggcaacaagatcattgatgagcgcctgatcaac
ccagatggttcactcctcttccgcgttactatcaatggagtcaccggatggcgcctttgcgagcgtattcttgccgtt
tctctcgagccaaccactgaggatctgtactttcagagcgataacgatggatccgaaatcggtactggctttccattc
gacccccattatgtggaagtcctgggcgagcgcatgcactacgtcgatgttggtccgcgcgatggcacccctgtgctg
ttcctgcacggtaacccgacctcctcctacgtgtggcgcaacatcatcccgcatgttgcaccgacccatcgctgcatt
gctccagacctgatcggtatgggcaaatccgacaaaccagacctgggttatttcttcgacgaccacgtccgcttcatg
gatgccttcatcgaagccctgggtctggaagaggtcgtcctggtcattcacgactggggctccgctctgggtttccac
tgggccaagcgcaatccagagcgcgtcaaaggtattgcatttatggagttcatccgccctatcccgacctgggacgaa
tggccagaatttgcccgcgagacctccaggccttccgcaccaccgacgtcggccgcaagctgatcatcgatcagaac
gtttttatcgagggtacgctgccgatgggtgtcgtccgcccgctgactgaagtcgagatggaccattaccgcgagccg
ttcctgaatcctgttgaccgcgagccactgtggcgcttcccaaacgagctgccaatcgccggtgagccagcgaacatc
gtcgcgctggtcgaagaatacatggactggctgcaccagtccctgtcccgaagctgctgttctggggcacccaggc
gttctgatcccaccggccgaagccgctcgcctggccaaaagcctgcctaactgcaaggctgtggacatcggcccgggt
ctgaatctgctgcaagaagacaacccggacctgatcggcagcgagatcgcgcgctggctgtctactctggagatttcc
ggt SEQ ID NO: 58 (Id-IV-HT7 sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGGRGLPVRAPLSTLNGEISALAAEEAACVPADDRILCRVSLENLYFQASGGGGGAIAMVFTLEDFVGDWRQTA
GYNQDQVLEQGGLSSLFQKLGVSVTPIQKIVLSGENGLKIDIHVIIPYEGLSGFQMGLIEMIFKVVYPVDDHHFKVIL
HYGTLVIDGVTPNMIDYFGRPYEGIAVFDGKKITVTGTLWNGNKIIDERLINPDGSLLFRVTINGVTGWRLCERILAV
SLEPTTEDLYFQSDNDGSEIGTGFPFDPHYVEVLGERMHYVDVGPRDGTPVLFLHGNPTSSYVWRNIIPHVAPTHRCI
APDLIGMGKSDKPDLGYFFDDHVRFMDAFIEALGLEEVVLVIHDWGSALGFHWAKRNPERVKGIAFMEFIRPIPTWDE
WPEFARETFQARTTDVGRKLIIDQNVFIEGTLPMGVVRPLTEVEMDHYREPPFLNPVDREPLWRFPNELPIAGEPANI
VALVEEYMDWLHQSPVPKLLFWGTPGVLIPPAEAARLAKSLPNCKAVDIGPGLNLLQEDNPDLIGSEIARWLSTLEIS
G SEQ ID NO: 59 (Id-9B8 opt+K33N-HT7 sandwich fusion nucleotide)
atgcttggtctgtcggagcaaagcgtgtccatctcgcgctgcgctgggacgcgcctgcccgccttgctggacgagcag
caggtgaacgtcctgctctacgacatgaacggctgctactcacgcctcaaggagctggtgcccaccctgcccagaac
cgcaaagtgagcaaggtggagatcctgcagcatgtaatcgactacatcagggacctgcagctggagctgaactcggag
tctgaagtcgggaccaccggaggccggggactgcctgtccgcgccccgctcagcaccctgaacggcgagatcagtgcc
ttggcggccgaggcggcatgtgttccagccgacgatcgcatcttgtgtcgcgtttctcttgagaatctttattttcag
gcgtctggaggtggtggcggagcgatcgccatggtgtttacactcgagattcgtaggggactggcggcagacagcc
ggctacaacctggaccaagtccttgagcagggcggtctgtccagtttgtttcagaatctcggggtgtccgtaacaccg
atccaaaagattgtcctgagcggtgaaaacggcctgaagatcgacatccatgtcatcatcccgtatgaaggtctgagc
ggctatcagatgggccagatcgaaaaaattttttaaggtggtgtacctgtggatgatcatcactttaaggtgattctg
cactatggcacactggtaatcgacgggtttacgccgaacatgactacttttcgagcggccgtatgaaggcatcgcc
gtgttcgacggcaaaaagatcactgtaaccgggaccctgtggaacggcaacaaaattatcgacgagcgcctgatcaac
cccgacggctccctgctgttccgcgtaaccatcaacggagtgaccggctggcggtgtgcgagcgcattttggcggga
tatctcgagccaaccactgaggatctgtactttcagagcgataacgatggatccgaaatcggtactggctttccattc
gacccccattatgtggaagtcctgggcgagcgcatgcactacgtcgatgttggtccgcgcgatggcacccctgtgctg
ttcctgcacggtaacccgacctcctcctacgtgtggcgcaacatcatcccgcatgttgcaccgacccatcgctgcatt
gctccagacctgatcggtatgggcaaatccgacaaaccagacctgggttatttcttcgacgaccacgtccgcttcatg
gatgccttcatcgaagccctgggtctggaagaggtcgtcctggtcattcacgactggggctccgctctgggtttccac
tgggccaagcgcaatccagagcgcgtcaaaggtattgcatttatggagttcatccgccctatcccgacctgggacgaa
tggccagaatttgcccgcgagacctccaggccttccgcaccaccgacgtcggccgcaagctgatcatcgatcagaac
gtttttatcgagggtacgctgccgatgggtgtcgtccgcccgctgactgaagtcgagatggaccattaccgcgagccg
ttcctgaatcctgttgaccgcgagccactgtggcgcttcccaaacgagctgccaatcgccggtgagccagcgaacatc
gtcgcgctggtcgaagaatacatggactggctgcaccagtccctgtcccgaagctgctgttctggggcacccaggc
gttctgatcccaccggccgaagccgctcgcctggccaaaagcctgcctaactgcaaggctgtggacatcggcccgggt
ctgaatctgctgcaagaagacaacccggacctgatcggcagcgagatcgcgcgctggctgtctactctggagatttcc
ggt SEQ ID NO: 60 (Id-9B8 opt+K33N-HT7 sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGGRGLPVRAPLSTLNGEISALAAEEAACVPADDRILCRVSLENLYFQASGGGGGAIAMVFTLEDFVGDWRQTA
GYNLDQVLEQGGLSSLFQNLGVSVTPIQKIVLSGENGLKIDIHVIIPYEGLSGYQMGIEKIFKVVYPVPVDDHHFKVIL
HYGTLVIDGVTPNMIDYFGRPYEGIAVFDGKKITVTGTLWNGNKIIDERLINPDGSLLFRVTINGVTGWRLCERILAG
YLEPTTEDLYFQSDNDGSEIGTGFPFDPHYVEVLGERMHYVDVGPRDGTPVLFLHGNPTSSYVWRNIIPHVAPTHRCI
APDLIGMGKSDKPDLGYFFDDHVRFMDAFIEALGLEEVVLVIHDWGSALGFHWAKRNPERVKGIAFMEFIRPIPTWDE
WPEFARETFQARTTDVGRKLIIDQNVFIEGTLPMGVVRPLTEVEMDHYREPPFLNPVDREPLWRFPNELPIAGEPANI
VALVEEYMDWLHQSPVPKLLFWGTPGVLIPPAEAARLAKSLPNCKAVDIGPGLNLLQEDNPDLIGSEIARWLSTLEIS
G SEQ ID NO: 61 (Id-9B8-HT7 sandwich fusion nucleotide)
atgcttggtctgtcggagcaaagcgtgtccatctcgcgctgcgctgggacgcgcctgcccgccttgctggacgagcag
caggtgaacgtcctgctctacgacatgaacggctgctactcacgcctcaaggagctggtgcccaccctgcccagaac
cgcaaagtgagcaaggtggagatcctgcagcatgtaatcgactacatcagggacctgcagctggagctgaactcggag
tctgaagtcgggaccaccggaggccggggactgcctgtccgcgccccgctcagcaccctgaacggcgagatcagtgcc
ttggcggccgaggcggcatgtgttccagccgacgatcgcatcttgtgtcgcgtttctcttgagaatctttattttcag
gcgtctggaggtggtggcgagcgatcgccatggtgtttacattggagattcgttggagactggcggcagacagct
ggatacaacctagatcaagtgttagaacaaggaggattgtctagtctgttccaaaagctgggagtgtcagtcacccca
atccagaaaattgtgctgtctggggagaatgggttaaaaattgatattcatgtcatcatcccttacgagggactcagt
```

SEQUENCE LISTING

```
ggttatcaaatgggtcagattgaaaagatcttcaaagttgtttacccagtggatgatcatcatttcaaggttattctc
cattatggtacactcgttattgacggtgtgacaccaaacatgattgactactttggacgcccttacgagggaattgct
gtgtttgacggcaagaagatcacagttactggaactctgtggaacggcaacaagatcattgatgagcgcctgatcaac
ccagatggttcactcctcttccgcgttactatcaatggagtcaccggatggcgcctttgcgagcgtattcttgccgtt
tctctcgagccaaccactgaggatctgtactttcagagcgataacgatggatccgaaatcggtactggctttccattc
gacccccattatgtggaagtcctgggcgagcgcatgcactacgtcgatgttggtccgcgcgatggcacccctgtgctg
ttcctgcacggtaacccgacctcctcctacgtgtggcgcaacatcatcccgcatgttgcaccgacccatcgctgcatt
gctccagacctgatcggtatgggcaaatccgacaaaccagacctgggttattcttcgacgaccacgtccgcttcatg
gatgccttcatcgaagccctgggtctggaagaggtcgtcctggtcattcacgactgggctccgctctgggtttccac
tgggccaagcgcaatccagagcgcgtcaaaggtattgcatttatggagttcatccgccctatcccgacctgggacgaa
tggccagaatttgcccgcgagaccttccaggccttccgcaccaccgacgtcggccgcaagctgatcatcgatcagaac
gtttttatcgagggtacgctgccgatgggtgtcgtccgcccgctgactgaagtcgagatggaccattaccgcgagccg
ttcctgaatcctgttgaccgcgagccactgtggcgcttcccaaacgagctgccaatcgccggtgagccagcgaacatc
gtcgcgctggtcgaagaatacatggactggctgcaccagtccctgtcccgaagctgctgttctggggcaccccaggc
gttctgatcccaccggccgaagccgctcgcctggccaaaagcctgcctaactgcaaggctgtggacatcggcccgggt
ctgaatctgctgcaagaagacaacccggacctgatcggcagcgagatcgcgcgctggctgtctactctggagatttcc
ggt SEQ ID NO: 62 (Id-9B8-HT7 sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGGRGLPVRAPLSTLNGEISALAAEAACVPADDRILCRVSLENLYFQASGGGGGAIAMVFTLEDFVGDWRQTA
GYNLDQVLEQGGLSSLFQKLGVSVTPIQKIVLSGENGLKIDIHVIIPYEGLSGYQMGQIEKIFKVVYPVDDHHFKVIL
HYGTLVIDGVTPNMIDYFGRPYEGIAVFDGKKITVTGTLWNGNKIIDERLINPDGSLLFRVTINGVTGWRLCERILAV
SLEPTTEDLYFQSDNDGSEIGTFGPFDPHYVEVLGERMHYVDVGPRDGTPVLFLHGNPTSSYVWRNIIPHVAPTHRCI
APDLIGMGKSDKPDLGYFFDDHVRFMDAFIEALGLEEVVLVIHDWGSALGFHWAKRNPERVKGIAFMEFIRPIPTWDE
WPEFARETFQAFRTTDVGRKLIIDQNVFIEGTLPMGVVRPLTEVEMDHYREPPFLNPVDREPLWRFPNELPIAGEPANI
VALVEEYMDWLHQSPVPKLLFWGTPGVLIPPAEAARLAKSLPNCKAVDIGPGLNLLQEDNPDLIGSEIARWLSTLEIS
G SEQ ID NO: 63 (Id-9F6-HT7 sandwich fusion nucleotide)
atgcttggtctgtcggagcaaagcgtgtccatctcgcgctgcgctgggacgcgcctgcccgccttgctggacgagcag
caggtgaacgtcctgctctacgacatgaacggctgctactcacgcctcaaggagctggtgcccaccctgccccagaac
cgcaaagtgagcaaggtggagatcctgcagcatgtaatcgactacatcagggacctggactgggagctgaactcggag
tctgaagtcgggaccaccggaggccggggactgcctgtccgcgccccgctcagcaccctgaacggcgagatcagtgcc
ttggcggccgaggcggcatgtgttccagccgacgatcgcatcttgtgtcgcgtttctcttgagaatctttatttcag
gcgtctggaggtggtggcggagcgatcgccatggtgtttacattggaggatttcgttggagactggcggcagacagct
ggatacaacctagatcaagtgttagaacaaggaggagtgtctagtctgttccaaaagctgggagtgtcaatcaccca
atccagaaaattgtgctgtctgggagaatgggtaaaaattgatattcatgtcatcatcccttacgagggactcagt
ggttatcaaatgggtcagattgaaaagatcttcaaagttgtttacccagtggatgatcatcatttcaaggttattctc
cattatggtacactcgttattgacggtgtgacaccaaacatgattgactactttggacgcccttacgagggaattgct
gtgtttgacggcaagaagatcacagttactggaactctgtggaacggcaacaagatcattgatgagcgcctgatcaac
ccagatggttcactcctcttccgcgttactatcaatggagtcaccggatggcgcctttgcgagcgtattcttgccgtt
tctctcgagccaaccactgaggatctgtactttcagagcgataacgatggatccgaaatcggtactggctttccattc
gacccccattatgtggaagtcctgggcgagcgcatgcactacgtcgatgttggtccgcgcgatggcacccctgtgctg
ttcctgcacggtaacccgacctcctcctacgtgtggcgcaacatcatcccgcatgttgcaccgacccatcgctgcatt
gctccagacctgatcggtatgggcaaatccgacaaaccagacctgggttattcttcgacgaccacgtccgcttcatg
gatgccttcatcgaagccctgggtctggaagaggtcgtcctggtcattcacgactgggctccgctctgggtttccac
tgggccaagcgcaatccagagcgcgtcaaaggtattgcatttatggagttcatccgccctatcccgacctgggacgaa
tggccagaatttgcccgcgagaccttccaggccttccgcaccaccgacgtcggccgcaagctgatcatcgatcagaac
gtttttatcgagggtacgctgccgatgggtgtcgtccgcccgctgactgaagtcgagatggaccattaccgcgagccg
ttcctgaatcctgttgaccgcgagccactgtggcgcttcccaaacgagctgccaatcgccggtgagccagcgaacatc
gtcgcgctggtcgaagaatacatggactggctgcaccagtccctgtcccgaagctgctgttctggggcaccccaggc
gttctgatcccaccggccgaagccgctcgcctggccaaaagcctgcctaactgcaaggctgtggacatcggcccgggt
ctgaatctgctgcaagaagacaacccggacctgatcggcagcgagatcgcgcgctggctgtctactctggagatttcc
ggt SEQ ID NO: 64 (Id-9F6-HT7 sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGGRGLPVRAPLSTLNGEISALAAEAACVPADDRILCRVSLENLYFQASGGGGGAIAMVFTLEDFVGDWRQTA
GYNLDQVLEQGGVSSLFQKLGVSITPIQKIVLSGENGLKIDIHVIIPYEGLSGYQMGQIEKIFKVVYPVDDHHFKVIL
HYGTLVIDGVTPNMIDYFGRPYEGIAVFDGKKITVTGTLWNGNKIIDERLINPDGSLLFRVTINGVTGWRLCERILAV
SLEPTTEDLYFQSDNDGSEIGTFGPFDPHYVEVLGERMHYVDVGPRDGTPVLFLHGNPTSSYVWRNIIPHVAPTHRCI
APDLIGMGKSDKPDLGYFFDDHVRFMDAFIEALGLEEVVLVIHDWGSALGFHWAKRNPERVKGIAFMEFIRPIPTWDE
WPEFARETFQAFRTTDVGRKLIIDQNVFIEGTLPMGVVRPLTEVEMDHYREPPFLNPVDREPLWRFPNELPIAGEPANI
VALVEEYMDWLHQSPVPKLLFWGTPGVLIPPAEAARLAKSLPNCKAVDIGPGLNLLQEDNPDLIGSEIARWLSTLEIS
G SEQ ID NO: 65 (9B8 opt-P nucleotide)
atggtgtttacactcgaagatttcgtaggggactggcggcagacagccggctacaacctggaccaagtccttgagcag
ggccggtctgtccagtttgtttcagaaactcggggtgtccgtaacaccgatccaaaagattgtcctgagcggtgaaaac
ggcctgaagatcgacatccatgtcatcatcccgtatgaaggtctgagcggctatcagatgggccagatcgaaaaaatt
tttaaggtggttaccctgtggatgatcatcactttaaggtgattctgcactatggcacactggtaatcgacggggtt
acgccgaacatgatcgactatttcggacggcgtatgaaggcatcgccgtgttcgacggcaaaaagatcactgtaacc
gggaccctgtggaacggcaacaaaattatcgacgagcgcctgatcaaccccgacggctccctgctgttccgcgtaacc
atcaacggagtgaccggctggcggctgtgcgagcgcattttggcgaattctcacggcttccctcccgaggtggaggag
caggccgccggcaccctgcccatgagctgcgcccaggagagcggcatggatagacaccctgctgcttgcgccagcgcc
aggatcaacgtc
```

SEQUENCE LISTING

SEQ ID NO: 66 (2X ARE)
TAGCTTGGAAATGACATTGCTAATGGTGACAAAGCAACTTTTAGCTTGGAAATGACATTGCTAATGGTGACAAAGCAA
CTTT

SEQ ID NO: 67 (HRE)
CTGGAATTTTCTAGACTGGAATTTTCTAGACTGGAATTTTCTAGA

SEQ ID NO: 68 (K33N+170G nucleotide)
atggtgtttacactcgaagatttcgtaggggactggcggcagacagccggctacaacctggaccaagtccttgagcag
ggcggtctgtccagtttgtttcagaatctcggggtgtccgtaacaccgatccaaaagattgtcctgagcggtgaaaac
ggcctgaagatcgacatccatgtcatcatcccgtatgaaggtctgagcggctatcagatgggccagatcgaaaaaatt
tttaaggtggtgtaccctgtggatgatcatcactttaaggtgattctgcactatggcacactggtaatcgacggggtt
acgccgaacatgatcgactatttcggacggccgtatgaaggcatcgccgtgttcgacggcaaaaagatcactgtaacc
gggaccctgtggaacggcaacaaaattatcgacgagcgcctgatcaaccccgacggctccctgctgttccgcgtaacc
atcaacggagtgaccggctggcggctgtgcgagcgcattttggcggga SEQ ID NO: 69 (K33N+170G protein)
MVFTLEDFVGDWRQTAGYNLDQVLEQGGLSSLFQNLGVSVTPIQKIVLSGENGLKIDIHVIIPYEGLSGYQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILAG SEQ ID NO: 70 (27A5 (NF) nucleotide)
ATGGTGTTTACACTCGAAGATTTCGTAGGGGACTGGCGGCAGACAGCCGGCTACAACCTGGACCAAGTCCTTGAGCAG
GGCGGTCTGTCCAGTTTGTTTCAGAATCTCGGGGTGTCCGTAACTCCGATCCAAAAGATTGTCCTGAGCGGTGAAAAC
GGCCTGAAGATCGACATCCATGTCATCATCCCGTATGAAGGTCTGAGCGGCTATCAGATGGGCCAGATCGAAAAAATT
TTTAAGGTGGTGTACCCTGTGGATGATCATCACTTTAAGGTGATTCTGCACTATGGCACACTGGTAATCGACGGGGTT
ACGCCGAACATGATCGACTATTTCGGACGGCCGTATGAAGGCATCGCCGTGTTCGACGGCAAAAAGATCACTGTAACC
GGGACCCTGTGGAACGGCAACAAAATTATCGACGAGCGCCTGATCAACCCCGACGGCTCCCTGCTGTTCCGCGTAACC
ATCAACGGAGTGACCGGCTGGCGGCTGTGCGAGCGCATTTTGGCGGGA SEQ ID NO: 71 (27A5 (NF) protein)
MVFTLEDFVGDWRQTAGYNLDQVLEQGGLSSLFQNLGVSVTPIQKIVLSGENGLKIDIHVIIPYEGLSGYQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILAG SEQ ID NO: 72 (23D4 (NF) nucleotide)
ATGGTGTTTACACTCGAAGATTTCGTAGGGGACTGGCGGCAGACAGCCGGCTACAACCTGGACCAAGTCCTTGAGCAG
GGCGGCCTGTCCAGTTTGTTTCAGAATCTCGGGGTGTCCGTAACACCGATCCAAAAGATTGTCCTGAGCGGTGAAAAC
GGCCTGAAGATCGACATCCATGTCATCATCCCGTATGAAGGTCTGAGCGGCTATCAGATGGGCCAGATCGAAAAAATT
TTTAAGGTGGTGTACCCTGTGGATGATCATCACTTTAAGGTGATTCTGCACTATGGCACACTGGTAATCGACGGGGTT
ACGCCGAACTTGATCGACTATTTCGGACGTCCGTATGAAGGCATCGCCGTGTTCGACGGCAAAAAGATCACTGTAACC
GGGACCCTGTGGAACGGCAACAAAATTATCGACGAGCGCCTGATCAACCCCGACGGCTCCCTGCTGTTCCGCGTAACC
ATCAACGGAGTGACCGGCTGGCGGCTGTGCGAGCGCATTTTGGCGGGA SEQ ID NO: 73 (23D4 (NF) protein)
MVFTLEDFVGDWRQTAGYNLDQVLEQGGLSSLFQNLGVSVTPIQKIVLSGENGLKIDIHVIIPYEGLSGYQMGQIEKI
FKVVYPVDDHHFKVILHYGTLVIDGVTPNLIDYFGRPYEGIAVFDGKKITVTGTLWNGNKIIDERLINPDGSLLFRVT
INGVTGWRLCERILAG SEQ ID NO: 74 (24C2 (NF) nucleotide)
ATGGTGTTTACACTCGAAGATTTCGTAGGGGACTGGCAGCAGACAGCCGGCTACAACCTGGACCAAGTCCTTGAGCAG
GGCGGTCTGTCCAGTTTGTTTCAGAATCTCGGGGTGTCCGTAACTCCGATCCAAAAGATTGTCCTGAGCGGTGAAAAC
GGCCTGAAGATCGACATCCATGTCATCATCCCGTATGAAGGTCTGAGCGGCTATCAGATGGGCCAGATCGAAAAAATT
TTTAAGGTGGTGTACCCTGTGGATGATCATCACTTTAAGGTGATTCTGCACTATGGCACACTGGTAATCGACGGGGTT
ACGCCGAACATGATCGACTATTTCGGACGGCCGTATGAAGGCATCGCCGTGTTCGACGGCAAAAAGATCACTGTAACC
GGGACCCTGTGGAACGGCAACAAAATTATCGACGAGCGCCTGATCAACCCCGACGGCTCCCTGCTGTTCCGCGTAACC
ATCAACGGAGTGACCGGCTGGCGGCTGTGCGAGCGCATTTTGGCGGGA SEQ ID NO: 75 (24C2 (NF) protein)
MVFTLEDFVGDWQQTAGYNLDQVLEQGGLSSLFQNLGVSVTPIQKIVLSGENGLKIDIHVIIPYEGLSGYQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILAG SEQ ID NO: 76 (Id-23D4-HT7 sandwich fusion nucleotide)
atgcttggtctgtcggagcaaagcgtgtccatctcgcgctgcgctgggacgcgcctgcccgccttgctggacgagcag
caggtgaacgtcctgctctacgacatgaacggctgctactcacgcctcaaggagctggtgcccaccctgccccagaac
cgcaaagtgagcaaggtggagatcctgcagcatgtaatcgactactacagggacctgcagctggagctgaactcggag
tctgaagtcgggaccaccggaggccgggactgcctgtccgcgcccctcagcaccctgaacggcgagatcagtgcc
ttggcggccgaggcggcatgtgttccagccgacgatcgcatcttgtgtcgcgtttctcttgagaatctttattttcag
gcgtctggaggtggtggcggagcgatcgccatggtgtttacactcgaagatttcgtaggggactggcggcagacagcc
ggctacaacctggaccaagtccttgagcaggcgcggcctgtccagtttgtttcagaatctcggggtgtccgtaacaccg
atccaaaagattgtcctgagcggtgaaaacggcctgaagatcgacatccatgtcatcatcccgtatgaaggtctgagc
ggctatcagatgggccagatcgaaaaaatttttaaggtggtgtaccctgtggatgatcatcactttaaggtgattctg
cactatggcacactggtaatcgacggggttacgccgaacttgatcgactatttcggacgtccgtatgaaggcatcgcc
gtgttcgacggcaaaaagatcactgtaaccgggaccctgtggaacggcaacaaaattatcgacgagcgcctgatcaac
cccgacggctccctgctgttccgcgtaaccatcaacggagtgaccggctggcggctgtgcgagcgcattttggcggga

SEQUENCE LISTING

```
tatctcgagccaaccactgaggatctgtactttcagagcgataacgatggatccgaaatcggtactggctttccattc
gacccccattatgtggaagtcctgggcgagcgcatgcactacgtcgatgttggtccgcgcgatggcaccctgtgctg
ttcctgcacggtaacccgacctcctcctacgtgtggcgcaacatcatcccgcatgttgcaccgacccatcgctgcatt
gctccagacctgatcggtatgggcaaatccgacaaaccagacctgggttatttcttcgacgaccacgtccgcttcatg
gatgccttcatcgaagccctgggtctggaagaggtcgtcctggtcattcacgactggggctccgctctgggtttccac
tgggccaagcgcaatccagagcgcgtcaaaggtattgcatttatggagttcatccgccctatcccgacctgggacgaa
tggccagaatttgcccgcgagaccttccaggccttccgcaccaccgacgtcggccgcaagctgatcatcgatcagaac
gtttttatcgagggtacgctgccgatgggtgtcgtccgcccgctgactgaagtcgagatggaccattaccgcgagccg
ttcctgaatcctgttgaccgcgagccactgtggcgcttcccaaacgagctgccaatcgccggtgagccagcgaacatc
gtcgcgctggtcgaagaatacatggactggctgcaccagtccctgtcccgaagctgctgttctggggcaccccaggc
gttctgatcccaccggccgaagccgctcgcctggccaaaagcctgcctaactgcaaggctgtggacatcggcccgggt
ctg
```

SEQ ID NO: 77 (Id-23D4-HT7 sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGGRGLPVRAPLSTLNGEISALAAEEAACVPADDRILCRVSLENLYFQASGGGGGAIAMVFTLEDFVGDWRQTA
GYNLDQVLEQGGLSSLFQNLGVSVTPIQKIVLSGENGLKIDIHVIIPYEGLSGYQMGQIEKIFKVVYPVDDHHFKVIL
HYGTLVIDGVTPNLIDYFGRPYEGIAVFDGKKITVTGTLWNGNKIIDERLINPDGSLLFRVTINGVTGWRLCERILAG
YLEPTTEDLYFQSDNDGSEIGTGFPFDPHYVEVLGERMHYVDVGPRDGTPVLFLHGNPTSSYVWRNIIPHVAPTHRCI
APDLIGMGKSDKPDLGYFFDDHVRFMDAFIEALGLEEVVLVIHDWGSALGFHWAKRNPERVKGIAFMEFIRPIPTWDE
WPEFARETFQAFRTTDVGRKLIIDQNVFIEGTLPMGVVRPLTEVEMDHYREPFLNPVDREPLWRFPNELPIAGEPANI
VALVEEYMDWLHQSPVPKLLFWGTPGVLIPPAEAARLAKSLPNCKAVDIGPGL SEQ ID NO: 78 (Id-24C2-HT7 sandwich fusion nucleotide)
```
atgcttggtctgtcggagcaaagcgtgtccatctcgcgctgcgctgggacgcgcctgcccgccttgctggacgagcag
caggtgaacgtcctgctctacgacatgaacggctgctactcacgcctcaaggagctggtgcccaccctgccccagaac
cgcaaagtgagcaaggtggagatcctgcagcatgtaatcgactacatcagggacctggagctggagctcaatgcggag
tctgaagtcgggaccaccggaggccggggactgcctgtccgcgccccgctcagcaccctgaacggcgagatcagtgcc
ttggcggccgaggcggcatgtgttccagccgacgatcgcatcttgtgtcgcgtttctcttgagaatctttatttttcag
gcgtctggaggtggtggcggagcgatcgccatggtgtttacactcgaagatttcgtaggggactggcagcagacagcc
ggctacaacctggaccaagtccttgagcagggcggtctgtccagtttgtttcagaatctcggggtgtccgtaactccg
atccaaaagattgtcctgagcggtgaaaacggcctgaagatcgacatccatgtcatcatcccgtataaggtctgagc
ggctatcagatgggccagatcgaaaaaatttttaaggtggtgtaccctgtggatgatcatcactttaaggtgattctg
cactatggcacactggtaatcgacggggttacgccgaacatgatcgactatttcggacggccgtatgaaggcatcgcc
gtgttcgacggcaaaaagatcactgtaaccgggacctgtggaacggcaacaaaattatcgacgagcgcctgatcaac
cccgacggctccctgctgttccgcgtaaccatcaacggagtgaccggctggcggctgtgcgagcgcattttggcggga
tatctcgagccaaccactgaggatctgtactttcagagcgataacgatggatccgaaatcggtactggctttccattc
gacccccattatgtggaagtcctgggcgagcgcatgcactacgtcgatgttggtccgcgcgatggcaccctgtgctg
ttcctgcacggtaacccgacctcctcctacgtgtggcgcaacatcatcccgcatgttgcaccgacccatcgctgcatt
gctccagacctgatcggtatgggcaaatccgacaaaccagacctgggttatttcttcgacgaccacgtccgcttcatg
gatgccttcatcgaagccctgggtctggaagaggtcgtcctggtcattcacgactggggctccgctctgggtttccac
tgggccaagcgcaatccagagcgcgtcaaaggtattgcatttatggagttcatccgccctatcccgacctgggacgaa
tggccagaatttgcccgcgagaccttccaggccttccgcaccaccgacgtcggccgcaagctgatcatcgatcagaac
gtttttatcgagggtacgctgccgatgggtgtcgtccgcccgctgactgaagtcgagatggaccattaccgcgagccg
ttcctgaatcctgttgaccgcgagccactgtggcgcttcccaaacgagctgccaatcgccggtgagccagcgaacatc
gtcgcgctggtcgaagaatacatggactggctgcaccagtccctgtcccgaagctgctgttctggggcaccccaggc
gttctgatcccaccggccgaagccgctcgcctggccaaaagcctgcctaactgcaaggctgtggacatcggcccgggt
ctgaatctgctgcaagaagacaacccggacctgatcggcagcgagatcgcgcgctggctgtctactctggagatttcc
ggt
```

SEQ ID NO: 79 (Id-24C2-HT7 sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGGRGLPVRAPLSTLNGEISALAAEEAACVPADDRILCRVSLENLYFQASGGGGGAIAMVFTLEDFVGDWRQTA
GYNLDQVLEQGGLSSLFQNLGVSVTPIQKIVLSGENGLKIDIHVIIPYEGLSGYQMGQIEKIFKVVYPVDDHHFKVIL
HYGTLVIDGVTPNMIDYFGRPYEGIAVFDGKKITVTGTLWNGNKIIDERLINPDGSLLFRVTINGVTGWRLCERILAG
YLEPTTEDLYFQSDNDGSEIGTGFPFDPHYVEVLGERMHYVDVGPRDGTPVLFLHGNPTSSYVWRNIIPHVAPTHRCI
APDLIGMGKSDKPDLGYFFDDHVRFMDAFIEALGLEEVVLVIHDWGSALGFHWAKRNPERVKGIAFMEFIRPIPTWDE
WPEFARETFQAFRTTDVGRKLIIDQNVFIEGTLPMGVVRPLTEVEMDHYREPFLNPVDREPLWRFPNELPIAGEPANI
VALVEEYMDWLHQSPVPKLLFWGTPGVLIPPAEAARLAKSLPNCKAVDIGPGLNLLQEDNPDLIGSEIARWLSTLEIS
G SEQ ID NO: 80 (1F7 (NF) nucleotide)
```
ATGGTGTTTACACTCGAAGATTTCGTAGGGGACTGGCGGCAGACAGCCGGCTACAACCTGGACCAAGTCCTTGAGCAG
GGCGGTCTGTCCAGTTTGTTTCAGAATCTCGGGGTGTCCGTAACACCGATCCAAAGGATTGTCCTGAGCGGTGAAAAC
GGCCTGAAGATCGACATCCATGTCATCATCCCGTATGAAGGTCTGAGCGGCGATCAGATGGGCCAGATCGAAAAAATT
TTTAAGGTGGTGTACCCTGTGGATGATCATCACTTTAAGGTGATTCTGCACTATGGCACACTGGTAATCGACGGGGTT
ACGCCGAACATGATCGACTATTTCGGACGGCCGTATGAAGGCATCGCCGTGTTCGACGGCAAAAAGATCACTGTAACC
GGGACCCTGTGGAACGGCAACAAAATTATCGACGAGCGCCTGATCAACCCCGACGGCTCCCTGCTGTTCCGCGTAACC
ATCAACGGAGTGACCGGCTGGCGGCTGTGCGAGCGCATTTTGGCGGGA
```

SEQ ID NO: 81 (1F7 (NF) protein)
MVFTLEDFVGDWRQTAGYNLDQVLEQGGLSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILAG

SEQUENCE LISTING

SEQ ID NO: 82 (15H1 (NF) nucleotide)
ATGGTGTTTACACTCGAAGATTTCGTAGGGGACTGGCGGCAGACAGCCGGCTACAACCTGGATCAAGTCCTTGAGCAG
GGCGGTCTGTCCAGTTTGTTTCAGAATCTCGGGGTGTCCGTAACACCGATCCAAAAGATTGTCCTGAGCGGTGAAAAC
GGCCTGAAGATCGACATCCATGTCATCATCCCGTATGAAGGTCTGAACGGCTATCAGATGGGCCAGATCGAAAAAATT
TTTAAGGTGGTGTACCCTGTGGATGATCATCACTTTAAGGTGATTCTGCACTATGGCACACTGGTAATCGACGGGGTT
ACGCCGAACATGATCGACTATTTCGGACGGCCGTATGAAGGCATCGCCGTGTTCGACGGCAAAAAGATCACTGTAACC
GGGACCCTGTGGAACGGCAACAAAATTATCGACGAGCGCCTGATCAACCCCGACGGCTCCCTGCTGTTCCGCGTAACC
ATCAACGGAGTGACCGGCTGGCGGCTGTGCGAGCGCATTTTGGCGGGA SEQ ID NO: 83 (15H1 (NF) protein)
MVFTLEDFVGDWRQTAGYNLDQVLEQGGLSSLFQNLGVSVTPIQKIVLSGENGLKIDIHVIIPYEGLNGYQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILAG SEQ ID NO: 84 (Id-1F7-HT7 sandwich fusion nucleotide)
atgcttggtctgtcggagcaaagcgtgtccatctcgcgctgcgctgggacgcgcctgcccgccttgctggacgagcag
caggtgaacgtcctgctctacgacatgaacggctgctactcacgcctcaaggagctggtgcccaccctgccccagaac
cgcaaagtgagcaaggtggagatcctgcagcatgtaatcgactacatcagggacctgcagctggagctgaactcggag
tctgaagtcgggaccaccggaggccggggactgcctgtccgcgccccgctcagcaccctgaacggcgagatcagtgcc
ttggcggccgaggcggcatgtgttccagccgacgatcgcatcttgtgtcgcgtttctcttgagaatctttattttcag
gcgtctggaggtggtggcggagcgatcgccatggtgtttacactcgaagatttcgtaggggactggcggcagacagcc
ggctacaacctggaccaagtccttgagcagggcggtctgtccagtttgtttcagaatctcggggtgtccgtaacaccg
atccaaaggattgtcctgagcggtgaaaacggcctgaagatcgacatccatgtcatcatcccgtatgaaggtctgagc
ggcgatcagatgggccagatcgaaaaaattttttaaggtggtgtaccctgtggatgatcatcacttttaaggtgattctg
cactatggcacactggtaatcgacggggttacgccgaacatgatcgactatttcggacggccgtatgaaggcatcgcc
gtgttcgacggcaaaaagatcactgtaaccgggaccctgtggaacggcaacaaaattatcgacgagcgcctgatcaac
cccgacggctccctgctgttccgcgtaaccatcaacggagtgaccggctggcggctgtgcgagcgcattttggcggga
tatctcgagccaaccactgaggatctgtactttcagagcgataacgatggatccgaaatcggtactggctttccattc
gacccccattatgtggaagtcctgggcgagcgcatgcactacgtcgatgttggtccgcgcgatggcacccctgtgctg
ttcctgcacggtaacccgacctcctcctacgtgtggcgcaacatcatcccgcatgttgcaccgacccatcgctgcatt
gctccagacctgatcggtatgggcaaatccgacaaaccagacctgggttattcttcgacgaccacgtccgcttcatg
gatgccttcatcgaagccctgggtctggaagaggtcgtcctggtcattcacgactggggctccgctctgggtttccac
tgggccaagcgcaatccagagcgcgtcaaaggtattgcatttatggagttcatccgccctatcccgacctgggacgaa
tggccagaatttgcccgcgagaccttccaggcttccgcaccaccgacgtcggccgcaagctgatcatcgatcagaac
gtttttatcgagggtacgctgccgatgggtgtcgtccgcccgctgactgaagtcgagatggaccattaccgcgagccg
ttcctgaatcctgttgaccgcgagccactgtggcgcttcccaaacgagctgccaatcgccggtgagccagcgaacatc
gtcgcgctggtcgaagaatacatggactggctgcaccagtcccctgtcccgaagctgctgttctggggcaccccaggc
gttctgatcccaccggccgaagcgctcgcctggccaaaagcctgcctaactgcaaggctgtggacatcggcccgggt
ctgaatctgctgcaagaagacaacccggacctgatcggcagcgagatcgcgcgctggctgtctactctggag SEQ ID NO: 85 (Id-1F7-HT7 sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGGRGLPVRAPLSTLNGEISALAAEEAACVPADDRILCRVSLENLYFQASGGGGAIAMVFTLEDFVGDWRQTA
GYNLDQVLEQGGLSSLFQNLGVSVTPIQRIVLSGENGLKIDIHVIIPYEGLSGDQMGQIEKIFKVVYPVDDHHFKVIL
HYGTLVIDGVTPNMIDYFGRPYEGIAVFDGKKITVTGTLWNGNKIIDERLINPDGSLLFRVTINGVTGWRLCERILAG
YLEPTTEDLYFQSDNDGSEIGTGFPFDPHYVEVLGERMHYVDVGPRDGTPVLFLHGNPTSSYVWRNIIPHVAPTHRCI
APDLIGMGKSDKPDLYFFDDHVRFMDAFIEALGLEEVVLVIHDWGSALGFHWAKRNPERVKGIAFMEFIRPIPTWDE
WPEFARETFQAFRTTDVGRKLIIDQNVFIEGTLPMGVVRPLTEVEMDHYREPFLNPVDREPLWRFPNELPIAGEPANI
VALVEEYMDWLHQSPVPKLLFWGTPGVLIPPAEAARLAKSLPNCKAVDIGPGLNLLQEDNPDLIGSEIARWLSTLEIS
G SEQ ID NO: 86 (Id-15H1-HT7 sandwich fusion nucleotide)
atgcttggtctgtcggagcaaagcgtgtccatctcgcgctgcgctgggacgcgcctgcccgccttgctggacgagcag
caggtgaacgtcctgctctacgacatgaacggctgctactcacgcctcaaggagctggtgcccaccctgccccagaac
cgcaaagtgagcaaggtggagatcctgcagcatgtaatcgactacatcagggacctgcagctggagctgaactcggag
tctgaagtcgggaccaccggaggccggggactgcctgtccgcgccccgctcagcaccctgaacggcgagatcagtgcc
ttggcggccgaggcggcatgtgttccagccgacgatcgcatcttgtgtcgcgtttctcttgagaatctttattttcag
gcgtctggaggtggtggcggagcgatcgccatggtgtttacactcgaagatttcgtaggggactggcggcagacagcc
ggctacaacctggaccaagtccttgagcagggcggtctgtccagtttgtttcagaatctcggggtgtccgtaacaccg
atccaaaggattgtcctgagcggtgaaaacggcctgaagatcgacatccatgtcatcatcccgtatgaaggtctgaac
ggctatcagatgggccagatcgaaaaaattttttaaggtggtgtaccctgtggatgatcatcacttttaaggtgattctg
cactatggcacactggtaatcgacggggttacgccgaacatgatcgactatttcggacggccgtatgaaggcatcgcc
gtgttcgacggcaaaaagatcactgtaaccgggaccctgtggaacggcaacaaaattatcgacgagcgcctgatcaac
cccgacggctccctgctgttccgcgtaaccatcaacggagtgaccggctggcggctgtgcgagcgcattttggcggga
tatctcgagccaaccactgaggatctgtactttcagagcgataacgatggatccgaaatcggtactggctttccattc
gacccccattatgtggaagtcctgggcgagcgcatgcactacgtcgatgttggtccgcgcgatggcacccctgtgctg
ttcctgcacggtaacccgacctcctcctacgtgtggcgcaacatcatcccgcatgttgcaccgacccatcgctgcatt
gctccagacctgatcggtatgggcaaatccgacaaaccagacctgggttattcttcgacgaccacgtccgcttcatg
gatgccttcatcgaagccctgggtctggaagaggtcgtcctggtcattcacgactggggctccgctctgggtttccac
tgggccaagcgcaatccagagcgcgtcaaaggtattgcatttatggagttcatccgccctatcccgacctgggacgaa
tggccagaatttgcccgcgagaccttccaggcttccgcaccaccgacgtcggccgcaagctgatcatcgatcagaac
gtttttatcgagggtacgctgccgatgggtgtcgtccgcccgctgactgaagtcgagatggaccattaccgcgagccg
ttcctgaatcctgttgaccgcgagccactgtggcgcttcccaaacgagctgccaatcgccggtgagccagcgaacatc
gtcgcgctggtcgaagaatacatggactggctgcaccagtcccctgtcccgaagctgctgttctggggcaccccaggc

SEQUENCE LISTING gttctgatcccaccggccgaagccgctcgcctggccaaaagcctgcctaactgcaaggctgtggacatcggcccgggt
ctgaatctgctgcaagaagacaacccggacctgatcggcagcgagatcgcgcgctggctgtctactctggagatttcc
ggt SEQ ID NO: 87 (Id-15H1-HT7 sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGGRGLPVRAPLSTLNGEISALAAEAACVPADDRILCRVSLENLYFQASGGGGGAIAMVFTLEDFVGDWRQTA
GYNLDQVLEQGGLSSLFQNLGVSVTPIQKIVLSGENGLKIDIHVIIPYEGLNGYQMGQIEKIFKVVYPVDDHHFKVIL
HYGTLVIDGVTPNMIDYFGRPYEGIAVFDGKKITVTGTLWNGNKIIDERLINPDGSLLFRVTINGVTGWRLCERILAG
YLEPTTEDLYFQSDNDGSEIGTGFPFDPHYVEVLGERMHYVDVGPRDGTPVLFLHGNPTSSYVWRNIIPHVAPTHRCI
APDLIGMGKSDKPDLGYFFDDHVRFMDAFIEALGLEEVVLVIHDWGSALGFHWAKRNPERVKGIAFMEFIRPIPTWDE
WPEFARETFQAFRTTDVGRKLIIDQNVFIEGTLPMGVVRPLTEVEMDHYREPFLNPVDREPLWRFPNELPIAGEPANI
VALVEEYMDWLHQSPVPKLLFWGTPGVLIPPAEAARLAKSLPNCKAVDIGPGLNLLQEDNPDLIGSEIARWLSTLEIS
G SEQ ID NO: 88 (9B8 opt+K33N+L27V+T39T+K43R+Y68D nucleotide)
Atggtgtttacactcgaagatttcgtaggggactggcggcagacagccggctacaacctggaccaagtccttgagcag
ggcggtgtgtccagtttgtttcagaatctcggggtgtccgtaactccgatccaaaggattgtcctgagcggtgaaaac
ggcctgaagatcgacatccatgtcatcatcccgtatgaaggtctgagcggcgatcagatgggccagatcgaaaaaatt
tttaaggtggtgtaccctgtggatgatcatcacttttaaggtgattctgcactatggcacactggtaatcgacggggtt
acgccgaacatgatcgactatttcggacggccgtatgaaggcatcgccgtgttcgacggcaaaaagatcactgtaacc
gggaccctgtggaacggcaacaaaattatcgacgagcgcctgatcaaccccgacggctccctgctgttccgcgtaacc
atcaacggagtgaccggctggcggctgtgcgagcgcattttggcg SEQ ID NO: 89 (9B8 opt+K33N+L27V+T39T+K43R+Y68D protein)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILA SEQ ID NO: 90 (9B8 opt+K33N+L27V+T39T+K43R+Y68D sandwich fusion nucleotide)
atgcttggtctgtcggagcaaagcgtgtccatctcgcgctgcgctgggacgcgcctgcccgccttgctggacgagcag
caggtgaacgtcctgctctacgacatgaacggctgctactcacgcctcaaggagctggtgcccaccctgccccagaac
cgcaaagtgagcaaggtggagatcctgcagcatgtaatcgactacatacgtcgtgatcgtgagctggagctgaactcggag
tctgaagtcggggaccaccggaggccggggactgcctgtccgcgccccgctcagcacccctgaacggcgagatcagtgcc
ttggcggccgaggcggcatgtgttccagccgacgatcgcatcttgtgtcgcgtttctcttgagaatctttattttcag
gcgtctggaggtggtggcggagcgatcgccatggtgtttacactcgaagatttcgtaggggactggcggcagacagcc
ggctacaacctggaccaagtccttgagcagggcggtgtgtccagtttgtttcagaatctcggggtgtccgtaactccg
atccaaaggattgtcctgagcggtgaaaacggcctgaagatcgacatccatgtcatcatcccgtatgaaggtctgagc
ggcgatcagatgggccagatcgaaaaaattttaaggtggtgtaccctgtggatgatcatcacttttaaggtgattctg
cactatggcacactggtaatcgacggggttacgccgaacatgatcgactatttcggacggccgtatgaaggcatcgcc
gtgttcgacggcaaaaagatcactgtaacccgggaccctgtggaacggcaacaaaattatcgacgagcgcctgatcaac
cccgacggctccctgctgttccgcgtaaccatcaacggagtgaccggctggcggctgtgcgagcgcattttggcggga
tatctcgagccaaccactgaggatctgtactttcagagcgataacgatggatccgaaatcggtactggctttccattc
gaccccattatgtggaagtcctgggcgagcatgcgactacgtcgctgatgtggtccgcgcgatggcaccccgtgtgctg
ttcctgcacggtaacccgacctcctcctacgtgtggcgcaacatcatcccgcatgttgcaccgacccatcgctgcatt
gctccagacctgatcggtatgggcaaatccgacaaaccagacctgggttatttcttcgacgaccacgtccgcttcatg
gatgccttcatcgaagcccctgggtctggaagaggtcgtcctggtcattcacgactggggctccgctctgggtttccac
tgggccaagcgcaatccagagcgcgtcaaaggtattgcatttatggagttcatccgccctatcccgacctgggacgaa
tggccagaatttgcccgcgaaacctttccaggccttccgcaccaccgacgtcggccgcaagctgatcatcgatcagaac
gttttttatcgagggtacgctgccgatgggtgtcgtccgcccgctgactgaagtcgagatggaccattaccgcgagccg
ttcctgaatcctgttgaccgcgagccactgtggcgcttcccaaacgagctgccaatcgccggtgagccagcgaacatc
gtcgcgctggtcgaagaatacatggactggctgcaccagtcccctgtcccgaagctgctgttctggggcacccaggc
gttctgatcccaccggccgaagccgctcgcctggccaaaagcctgcctaactgcaaggctgtggacatcggcccgggt
ctgaatctgctgcaagaagacaacccggacctgatcggcagcgagatcgcgcgctggctgtctactctggagatttcc
ggt SEQ ID NO: 91 (9B8 opt+K33N+L27V+T39T+K43R+Y68D sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGGRGLPVRAPLSTLNGEISALAAEAACVPADDRILCRVSLENLYFQASGGGGAIAMVFTLEDFVGDWRQTA
GYNLDQVLEQGGVSSLFQNLGVSVTPIQRIVLSGENGLKIDIHVIIPYEGLSGDQMGQIEKIFKVVYPVDDHHFKVIL
HYGTLVIDGVTPNMIDYFGRPYEGIAVFDGKKITVTGTLWNGNKIIDERLINPDGSLLFRVTINGVTGWRLCERILAG
YLEPTTEDLYFQSDNDGSEIGTGFPFDPHYVEVLGERMHYVDVGPRDGTPVLFLHGNPTSSYVWRNIIPHVAPTHRCI
APDLIGMGKSDKPDLGYFFDDHVRFMDAFIEALGLEEVVLVIHDWGSALGFHWAKRNPERVKGIAFMEFIRPIPTWDE
WPEFARETFQAFRTTDVGRKLIIDQNVFIEGTLPMGVVRPLTEVEMDHYREPFLNPVDREPLWRFPNELPIAGEPANI
VALVEEYMDWLHQSPVPKLLFWGTPGVLIPPAEAARLAKSLPNCKAVDIGPGLNLLQEDNPDLIGSEIARWLSTLEIS
G SEQ ID NO: 92 (9B8 opt+K33N+T39T+K43R+Y68D nucleotide)
Atggtgtttacactcgaagatttcgtaggggactggcggcagacagccggctacaacctggaccaagtccttgagcag
ggcggtgtgtccagtttgtttcagaatctcggggtgtccgtaactccgatccaaaggattgtcctgagcggtgaaaac
ggcctgaagatcgacatccatgtcatcatcccgtatgaaggtctgagcggcgatcagatgggccagatcgaaaaaatt
tttaaggtggtgtaccctgtggatgatcatcacttttaaggtgattctgcactatggcacactggtaatcgacggggtt
acgccgaacatgatcgactatttcggacggccgtatgaaggcatcgccgtgttcgacggcaaaaagatcactgtaacc
gggaccctgtggaacggcaacaaaattatcgacgagcgcctgatcaaccccgacggctccctgctgttccgcgtaacc
atcaacggagtgaccggctggcggctgtgcgagcgcattttggcg

SEQUENCE LISTING

SEQ ID NO: 93 (9B8 opt+K33N+T39T+K43R+Y68D protein)
MVFTLEDFVGDWRQTAGYNLDQVLEQGGLSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILA SEQ ID NO: 94 (9B8 opt+K33N+T39T+K43R+Y68D sandwich fusion nucleotide)
atgcttggtctgtcggagcaaagcgtgtccatctcgcgctgcgctgggacgcgcctgcccgccttgctggacgagcag
caggtgaacgtcctgctctacgacatgaacggctgctactcacgcctcaaggagctggtgcccaccctgccccagaac
cgcaaagtgagcaaggtggagatcctgcagcatgtaatcgactacatcagggacctgcagctggagctgaactcggag
tctgaagtcgggaccaccggaggccgggactgcctgtccgcgcccgctcagcaccctgaacggcgagatcagtgcc
ttggcggccgaggcggcatgtgttccagccgacgatcgcatcttgtgtcgcgtttctcttgagaatctttatttttcag
gcgtctggaggtggtggcggagcgatcgccatggtgtttacactcgaagatttcgtagggggactggcggcagacagcc
ggctacaacctggaccaagtccttgagcagggcggtctgtccagtttgtttcagaatctcgggggtgtccgtaactccg
atccaaaggattgtcctgagcggtgaaaacggcctgaagatcgacatccatgtcatcatcccgtatgaaggtctgagc
ggcgatcagatgggccagatcgaaaaaattttaaggtggtgtaccctgtggatgatcatcactttaaggtgattctg
cactatggcacactggtaatcgacggggttacgccgaacatgatcgactatttcggacggccgtatgaaggcatcgcc
gtgttcgacggcaaaaagatcactgtaaccgggaccctgtggaacggcaacaaaattatcgacgagcgcctgatcaac
cccgacggctccctgctgttccgcgtaaccatcaacggagtgaccggctggcggctgtgcgagcgcattttggcggga
tatctcgagccaaccactgaggatctgtactttcagagcgataacgatggatccgaaatcggtactggctttccattc
gaccccattatgtggaagtcctgggcgagcgcatgcactacgtcgatgttggtccgcgcgatggcaccctgtgctg
ttcctgcacggtaacccgacctcctcctacgtgtggcgcaacatcatcccgcatgttgcaccgacccatcgctgcatt
gctccagacctgatcggtatgggcaaatccgacaaaccagacctgggttatttcttcgacgaccacgtccgcttcatg
gatgccttcatcgaagccctgggtctggaagaggtcgtcctggtcattcacgactgggctccgctctgggtttccac
tgggccaagcgcaatccagagcgcgtcaaaggtattgcatttatggagttcatccgcccatcccgacctgggacgaa
tggccagaatttgcccgcgagaccttccaggccttccgcaccaccgacgtcggccgcaagctgatcatcgatcagaac
gtttttatcgagggtacgctgccgatgggtgtcgtccgcccgctgactgaagtcgagatggaccattaccgcgagccg
ttcctgaatcctgttgaccgcgagccactgtggcgcttcccaaacgagctgccaatcgccggtgagccagcgaacatc
gtcgcgctggtcgaagaatacatggactggctgcaccagtccctgtcccgaagctgctgttctggggcaccccaggc
gttctgatcccaccggccgaagccgctcgcctggccaaaagcctgcctaactgcaaggctggacatcggcccgggt
ctgaatctgctgcaagaagacaacccggacctgatcggcagcgagatcgcgcgctggtcgtctactctggagatttcc
ggt SEQ ID NO: 95 (9B8 opt+K33N+T39T+K43R+Y68D sandwich fusion protein)
MLGLSEQSVSISRCAGTRLPALLDEQQVNVLLYDMNGCYSRLKELVPTLPQNRKVSKVEILQHVIDYIRDLQLELNSE
SEVGTTGGRGLPVRAPLSTLNGEISALAAEEAACVPADDRILCRVSLENLYFQASGGGGGAIAMVFTLEDFVGDWRQTA
GYNLDQVLEQGGLSSLFQNLGVSVTPIQRIVLSGENGLKIDIHVIIPYEGLSGDQMGQIEKIFKVVYPVDDHHFKVIL
HYGTLVIDGVTPNMIDYFGRPYEGIAVFDGKKITVTGTLWNGNKIIDERLINPDGSLLFRVTINGVTGWRLCERILAG
YLEPTTEDLYFQSDNDGSEIGTGFPFDPHYVEVLGERMHYVDVGPRDGTPVLFLHGNPTSSYVWRNIIPHVAPTHRCI
APDLIGMGKSDKPDLGYFFDDHVRFMDAFIEALGLEEVVLVIHDWGSALGFHWAKRNPERVKGIAFMEFIRPIPTWDE
WPEFARETFQAFRTTDVGRKLIIDQNVFIEGTLPMGVVRPLTEVEMDHYREPFLNPVDREPLWRFPNELPIAGEPANI
VALVEEYMDWLHQSPVPKLLFWGTPGVLIPPAEAARLAKSLPNCKAVDIGPGLNLLQEDNPDLIGSEIARWLSTLEIS
G SEQ ID NO: 96 (CRE)
GCACCAGACAGTGACGTCAGCTGCCAGATCCCATGGCCGTCATACTGTGACGTCTTTCAGACACCCCTTGACGTCAAT
GGGAGAACA SEQ ID NO: 97 (Nucleotide CP 84 no linker)
Atggatgatcatcactttaaggtgattctgcactatggcacactggtaatcgacggggttacgccgaacatgatcgac
tatttcggacggccgtatgaaggcatcgccgtgttcgacggcaaaaagatcactgtaaccgggaccctgtggaacggc
aacaaaattatcgacgagcgcctgatcaaccccgacggctccctgctgttccgcgtaaccatcaacggagtgaccggc
tggcggctgtgcgagcgcattttggcgatggtgtttacactcgaagatttcgtaggggactggcggcagacagccggc
tacaacctggaccaagtccttgagcagggcggtgtgtccagtttgtttcagaatctcgggggtgtccgtaactccgatc
caaaggattgtcctgagcggtgaaaacggcctgaagatcgacatccatgtcatcatcccgtatgaaggtctgagcggc
gatcagatgggccagatcgaaaaaattttaaggtggtgtaccctgtg SEQ ID NO: 98 (Protein CP 84 no linker)
MDDHHFKVILHYGTLVIDGVTPNMIDYFGRPYEGIAVFDGKKITVTGTLWNGNKIIDERLINPDGSLLFRVTINGVTG
WRLCERILAMVFTLEDFVGDWRQTAGYNLDQVLEQGGVSSLFQNLGVSVTPIQRIVLSGENGLKIDIHVIIPYEGLSG
DQMGQIEKIFKVVYPV SEQ ID NO: 99 (Nucleotide CP 84 5AA linker)
Atggatgatcatcactttaaggtgattctgcactatggcacactggtaatcgacggggttacgccgaacatgatcgac
tatttcggacggccgtatgaaggcatcgccgtgttcgacggcaaaaagatcactgtaaccgggaccctgtggaacggc
aacaaaattatcgacgagcgcctgatcaaccccgacggctccctgctgttccgcgtaaccatcaacggagtgaccggc
tggcggctgtgcgagcgcattttggcggggagctccggtggaatggtgtttacactcgaagatttcgtagggggactgg
cggcagacagccggctacaacctggaccaagtccttgagcagggcggtgtgtccagtttgtttcagaatctcggggtg
tccgtaactccgatccaaaggattgtcctgagcggtgaaaacggcctgaagatcgacatccatgtcatcatcccgtat
gaaggtctgagcggcgatcagatgggccagatcgaaaaaattttaaggtggtgtaccctgtg SEQ ID NO: 100 (Protein CP 84 5AA linker)
MDDHHFKVILHYGTLVIDGVTPNMIDYFGRPYEGIAVFDGKKITVTGTLWNGNKIIDERLINPDGSLLFRVTINGVTG
WRLCERILAGSSGGMVFTLEDFVGDWRQTAGYNLDQVLEQGGVSSLFQNLGVSVTPIQRIVLSGENGLKIDIHVIIPY
EGLSGDQMGQIEKIFKVVYPV -continued

SEQUENCE LISTING

SEQ ID NO: 101 (Nucleotide CP 84 10AA linker)
Atggatgatcatcactttaaggtgattctgcactatggcacactggtaatcgacggggttacgccgaacatgatcgac
tatttcggacggccgtatgaaggcatcgccgtgttcgacggcaaaaagatcactgtaaccgggaccctgtggaacggc
aacaaaattatcgacgagcgcctgatcaaccccgacggctccctgctgttccgcgtaaccatcaacggagtgaccggc
tggcggctgtgcgagcgcattttggcgggaagttctggtggagggagctccggtggaatggtgtttacactcgaagat
ttcgtagggggactggcggcagacagccggctacaacctggaccaagtccttgagcagggcggtgtgtccagtttgttt
cagaatctcggggtgtccgtaactccgatccaaaggattgtcctgagcggtgaaaacggcctgaagatcgacatccat
gtcatcatcccgtatgaaggtctgagcggcgatcagatgggccagatcgaaaaaattttttaaggtggtgtaccctgtg SEQ ID NO: 102 (Protein CP 84 10AA linker)
MDDHHFKVILHYGTLVIDGVTPNMIDYFGRPYEGIAVFDGKKITVTGTLWNGNKIIDERLINPDGSLLFRVTINGVTG
WRLCERILAGSSGGGSSGGMVFTLEDFVGDWRQTAGYNLDQVLEQGGVSSLFQNLGVSVTPIQRIVLSGENGLKIDIH
VIIPYEGLSGDQMGQIEKIFKVVYPV SEQ ID NO: 103 (Nucleotide CP 84 20AA linker)
Atggatgatcatcactttaaggtgattctgcactatggcacactggtaatcgacggggttacgccgaacatgatcgac
tatttcggacggccgtatgaaggcatcgccgtgttcgacggcaaaaagatcactgtaaccgggaccctgtggaacggc
aacaaaattatcgacgagcgcctgatcaaccccgacggctccctgctgttccgcgtaaccatcaacggagtgaccggc
tggcggctgtgcgagcgcattttggcgggaagttctggtggagggagctccggtggaatggtgtttacactcgaagat
tccggtggaatggtgtttacactcgaagatttcgtagggggactggcggcagacagccggctacaacctggaccaagtc
cttgagcagggcggtgtgtccagtttgtttcagaatctcggggtgtccgtaactccgatccaaaggattgtcctgagc
ggtgaaaacggcctgaagatcgacatccatgtcatcatcccgtatgaaggtctgagcggcgatcagatgggccagatc
gaaaaaattttttaaggtggtgtaccctgtg SEQ ID NO: 104 (Protein CP 84 20AA linker)
MDDHHFKVILHYGTLVIDGVTPNMIDYFGRPYEGIAVFDGKKITVTGTLWNGNKIIDERLINPDGSLLFRVTINGVTG
WRLCERILAGSSGGGSSGGGSSGGGSSGGMVFTLEDFVGDWRQTAGYNLDQVLEQGGVSSLFQNLGVSVTPIQRIVLS
GENGLKIDIHVIIPYEGLSGDQMGQIEKIFKVVYPV SEQ ID NO: 105 (Nucleotide CP 95 no linker)
Atgggcacactggtaatcgacggggttacgccgaacatgatcgactatttcggacggccgtatgaaggcatcgccgtg
ttcgacggcaaaaagatcactgtaaccgggaccctgtggaacggcaacaaaattatcgacgagcgcctgatcaacccc
gacggctccctgctgttccgcgtaaccatcaacggagtgaccggctggcggctgtgcgagcgcattttggcgatggtg
tttacactcgaagatttcgtagggggactggcggcagacagccggctacaacctggaccaagtccttgagcagggcggt
gtgtccagtttgtttcagaatctcggggtgtccgtaactccgatccaaaggattgtcctgagcggtgaaaacggcctg
aagatcgacatccatgtcatcatcccgtatgaaggtctgagcggcgatcagatgggccagatcgaaaaaattttttaag
gtggtgtaccctgtggatgatcatcactttaaggtgattctgcactat SEQ ID NO: 106 (Protein CP 95 no linker)
MGTLVIDGVTPNMIDYFGRPYEGIAVFDGKKITVTGTLWNGNKIIDERLINPDGSLLFRVTINGVTGWRLCERILAMV
FTLEDFVGDWRQTAGYNLDQVLEQGGVSSLFQNLGVSVTPIQRIVLSGENGLKIDIHVIIPYEGLSGDQMGQIEKIFK
VVYPVDDHHFKVILHY SEQ ID NO: 107 (Nucleotide CP 95 5AA linker)
Atgggcacactggtaatcgacggggttacgccgaacatgatcgactatttcggacggccgtatgaaggcatcgccgtg
ttcgacggcaaaaagatcactgtaaccgggaccctgtggaacggcaacaaaattatcgacgagcgcctgatcaacccc
gacggctccctgctgttccgcgtaaccatcaacggagtgaccggctggcggctgtgcgagcgcattttggcggggagc
tccggtggaatggtgtttacactcgaagatttcgtagggggactggcggcagacagccggctacaacctggaccaagtc
cttgagcagggcggtgtgtccagtttgtttcagaatctcggggtgtccgtaactccgatccaaaggattgtcctgagc
ggtgaaaacggcctgaagatcgacatccatgtcatcatcccgtatgaaggtctgagcggcgatcagatgggccagatc
gaaaaaattttttaaggtggtgtaccctgtggatgatcatcactttaaggtgattctgcactat SEQ ID NO: 108 (Protein CP 95 5AA linker)
MGTLVIDGVTPNMIDYFGRPYEGIAVFDGKKITVTGTLWNGNKIIDERLINPDGSLLFRVTINGVTGWRLCERILAGS
SGGMVFTLEDFVGDWRQTAGYNLDQVLEQGGVSSLFQNLGVSVTPIQRIVLSGENGLKIDIHVIIPYEGLSGDQMGQI
EKIFKVVYPVDDHHFKVILHY SEQ ID NO: 109 (Nucleotide CP 95 10AA linker)
Atgggcacactggtaatcgacggggttacgccgaacatgatcgactatttcggacggccgtatgaaggcatcgccgtg
ttcgacggcaaaaagatcactgtaaccgggaccctgtggaacggcaacaaaattatcgacgagcgcctgatcaacccc
gacggctccctgctgttccgcgtaaccatcaacggagtgaccggctggcggctgtgcgagcgcattttggcgggaagt
tctggtggagggagctccggtggaatggtgtttacactcgaagatttcgtagggggactggcggcagacagccggctac
aacctggaccaagtccttgagcagggcggtgtgtccagtttgtttcagaatctcggggtgtccgtaactccgatccaa
aggattgtcctgagcggtgaaaacggcctgaagatcgacatccatgtcatcatcccgtatgaaggtctgagcggcgat
cagatgggccagatcgaaaaaattttttaaggtggtgtaccctgtggatgatcatcactttaaggtgattctgcactat SEQ ID NO: 110 (Protein CP 95 10AA linker)
MGTLVIDGVTPNMIDYFGRPYEGIAVFDGKKITVTGTLWNGNKIIDERLINPDGSLLFRVTINGVTGWRLCERILAGS
SGGGSSGGMVFTLEDFVGDWRQTAGYNLDQVLEQGGVSSLFQNLGVSVTPIQRIVLSGENGLKIDIHVIIPYEGLSGD
QMGQIEKIFKVVYPVDDHHFKVILHY SEQ ID NO: 111 (Nucleotide CP 95 20AA linker)
Atgggcacactggtaatcgacggggttacgccgaacatgatcgactatttcggacggccgtatgaaggcatcgccgtg
ttcgacggcaaaaagatcactgtaaccgggaccctgtggaacggcaacaaaattatcgacgagcgcctgatcaacccc
gacggctccctgctgttccgcgtaaccatcaacggagtgaccggctggcggctgtgcgagcgcattttggcgggaagt
tctggtggagggagctccggtggagggagctccggtggaatggtgtttacactcgaagatttc

SEQUENCE LISTING

```
gtaggggactggcggcagacagccggctacaacctggaccaagtccttgagcagggcggtgtgtccagtttgtttcag
aatctcggggtgtccgtaactccgatccaaaggattgtcctgagcggtgaaaacggcctgaagatcgacatccatgtc
atcccgtatgaaggtctgagcggcgatcagatgggccagatcgaaaaaattttaaggtggtgtaccctgtggat
gatcatcactttaaggtgattctgcactat
```

SEQ ID NO: 112 (Protein CP 95 20AA linker)
MGTLVIDGVTPNMIDYFGRPYEGIAVFDGKKITVTGTLWNGNKIIDERLINPDGSLLFRVTINGVTGWRLCERILAGS
SGGGSSGGGSSGGGSSGGGSSGGMVFTLEDFVGDWRQTAGYNLDQVLEQGGVSSLFQNLGVSVTPIQRIVLSGENGLKIDIHV
IIPYEGLSGDQMGQIEKIFKVVYPVDDHHFKVILHY SEQ ID NO: 113 (Linker)
(GSGG)$_N$ SEQ ID NO: 114 (L27V CP 5 TEV)
```
Atggatttcgtaggggactggcggcagacagccggctacaacctggaccaagtccttgagcagggcggtgtgtccagt
ttgtttcagaatctcggggtgtccgtaactccgatccaaaggattgtcctgagcggtgaaaacggcctgaagatcgac
atccatgtcatcatcccgtatgaaggtctgagcggcgatcagatgggccagatcgaaaaaattttaaggtggtgtac
cctgtggatgatcatcactttaaggtgattctgcactatggcacactggtaatcgacggggttacgccgaacatgatc
gactatttcggacggccgtatgaaggcatcgccgtgttcgacggcaaaaagatcactgtaaccgggaccctgtggaac
ggcaacaaaattatcgacgagcgcctgatcaaccccgacggctccctgctgttccgcgtaaccatcaacggagtgacc
ggctggcggctgtgcgagcgcattttggcgggaagttctggtggaggaagttctggtggagagcctactactgagaac
ttgtacttccagagcgataacggaagttctggtggaggaagttctggtggaatggtgtttacactcgaa
```

SEQ ID NO: 115 (L27V CP 5 TEV)
MDFVGDWRQTAGYNLDQVLEQGGVSSLFQNLGVSVTPIQRIVLSGENGLKIDIHVIIPYEGLSGDQMGQIEKIFKVVY
PVDDHHFKVILHYGTLVIDGVTPNMIDYFGRPYEGIAVFDGKKITVTGTLWNGNKIIDERLINPDGSLLFRVTINGVT
GWRLCERILAGSSGGGSSGGEPTTENLYFQSDNGSSGGGSSGGMVFTLE

SEQ ID NO: 116 (L27V CP 6 TEV)
```
atgttcgtaggggactggcggcagacagccggctacaacctggaccaagtccttgagcagggcggtgtgtccagtttg
tttcagaatctcggggtgtccgtaactccgatccaaaggattgtcctgagcggtgaaaacggcctgaagatcgacatc
catgtcatcatcccgtatgaaggtctgagcggcgatcagatgggccagatcgaaaaaattttaaggtggtgtaccct
gtggatgatcatcactttaaggtgattctgcactatggcacactggtaatcgacggggttacgccgaacatgatcgac
tatttcggacggccgtatgaaggcatcgccgtgttcgacggcaaaaagatcactgtaaccgggaccctgtggaacggc
aacaaaattatcgacgagcgcctgatcaaccccgacggctccctgctgttccgcgtaaccatcaacggagtgaccggc
tggcggctgtgcgagcgcattttggcgggaagttctggtggaggaagttctggtggagagcctactactgagaacttg
tacttccagagcgataacggaagttctggtggaggaagttctggtggaatggtgtttacactcgaagat
```

SEQ ID NO: 117 (L27V CP 6 TEV)
MFVGDWRQTAGYNLDQVLEQGGVSSLFQNLGVSVTPIQRIVLSGENGLKIDIHVIIPYEGLSGDQMGQIEKIFKVVYP
VDDHHFKVILHYGTLVIDGVTPNMIDYFGRPYEGIAVFDGKKITVTGTLWNGNKIIDERLINPDGSLLFRVTINGVTG
WRLCERILAGSSGGGSSGGEPTTENLYFQSDNGSSGGGSSGGMVFTLED

SEQ ID NO: 118 (L27V CP 7 TEV)
```
atggtaggggactggcggcagacagccggctacaacctggaccaagtccttgagcagggcggtgtgtccagtttgttt
cagaatctcggggtgtccgtaactccgatccaaaggattgtcctgagcggtgaaaacggcctgaagatcgacatccat
gtcatcatcccgtatgaaggtctgagcggcgatcagatgggccagatcgaaaaaattttaaggtggtgtaccctgtg
gatgatcatcactttaaggtgattctgcactatggcacactggtaatcgacggggttacgccgaacatgatcgactat
ttcggacggccgtatgaaggcatcgccgtgttcgacggcaaaaagatcactgtaaccgggaccctgtggaacggcaac
aaaattatcgacgagcgcctgatcaaccccgacggctccctgctgttccgcgtaaccatcaacggagtgaccggctgg
cggctgtgcgagcgcattttggcgggaagttctggtggaggaagttctggtggagagcctactactgagaacttgtac
ttccagagcgataacggaagttctggtggaggaagttctggtggaatggtgtttacactcgaagatttc
```

SEQ ID NO: 119 (L27V CP 7 TEV)
MVGDWRQTAGYNLDQVLEQGGVSSLFQNLGVSVTPIQRIVLSGENGLKIDIHVIIPYEGLSGDQMGQIEKIFKVVYPV
DDHHFKVILHYGTLVIDGVTPNMIDYFGRPYEGIAVFDGKKITVTGTLWNGNKIIDERLINPDGSLLFRVTINGVTGW
RLCERILAGSSGGGSSGGEPTTENLYFQSDNGSSGGGSSGGMVFTLEDF

SEQ ID NO: 120 (L27V CP 9 TEV)
```
atggactggcggcagacagccggctacaacctggaccaagtccttgagcagggcggtgtgtccagtttgtttcagaat
ctcggggtgtccgtaactccgatccaaaggattgtcctgagcggtgaaaacggcctgaagatcgacatccatgtcatc
atcccgtatgaaggtctgagcggcgatcagatgggccagatcgaaaaaattttaaggtggtgtaccctgtggatgat
catcactttaaggtgattctgcactatggcacactggtaatcgacggggttacgccgaacatgatcgactatttcgga
cggccgtatgaaggcatcgccgtgttcgacggcaaaaagatcactgtaaccgggaccctgtggaacggcaacaaaatt
atcgacgagcgcctgatcaaccccgacggctccctgctgttccgcgtaaccatcaacggagtgaccggctggcggctg
tgcgagcgcattttggcgggaagttctggtggaggaagttctggtggagagcctactactgagaacttgtacttccag
agcgataacggaagttctggtggaggaagttctggtggaatggtgtttacactcgaagatttcgtaggg
```

SEQ ID NO: 121 (L27V CP 9 TEV)
MDWRQTAGYNLDQVLEQGGVSSLFQNLGVSVTPIQRIVLSGENGLKIDIHVIIPYEGLSGDQMGQIEKIFKVVYPVDD
HHFKVILHYGTLVIDGVTPNMIDYFGRPYEGIAVFDGKKITVTGTLWNGNKIIDERLINPDGSLLFRVTINGVTGWRL
CERILAGSSGGGSSGGEPTTENLYFQSDNGSSGGGSSGGMVFTLEDFVG

SEQ ID NO: 122 (L27V CP 11 TEV)
```
Atgcggcagacagccggctacaacctggaccaagtccttgagcagggcggtgtgtccagtttgtttcagaatctcggg
gtgtccgtaactccgatccaaaggattgtcctgagcggtgaaaacggcctgaagatcgacatccatgtcatcatcccg
tatgaaggtctgagcggcgatcagatgggccagatcgaaaaaattttaaggtggtgtaccctgtggatgatcatcac
```

-continued

SEQUENCE LISTING tttaaggtgattctgcactatggcacactggtaatcgacggggttacgccgaacatgatcgactatttcggacggccg
tatgaaggcatcgccgtgttcgacggcaaaaagatcactgtaaccgggaccctgtggaacggcaacaaaattatcgac
gagcgcctgatcaaccccgacggctccctgctgttccgcgtaaccatcaacggagtgaccggctggcggctgtgcgag
cgcattttggcgggaagttctggtggaggaagttctggtggagagcctactactgagaacttgtacttccagagcgat
aacggaagttctggtggaggaagttctggtggaatggtgtttacactcgaagatttcgtaggggactgg SEQ ID NO: 123 (L27V CP 11 TEV)
MRQTAGYNLDQVLEQGGVSSLFQNLGVSVTPIQRIVLSGENGLKIDIHVIIPYEGLSGDQMGQIEKIFKVVYPVDDHH
FKVILHYGTLVIDGVTPNMIDYFGRPYEGIAVFDGKKITVTGTLWNGNKIIDERLINPDGSLLFRVTINGVTGWRLCE
RILAGSSGGGSSGGEPTTENLYFQSDNGSSGGGSSGGMVFTLEDFVGDW SEQ ID NO: 124 (L27V CP 12 TEV)
Cagacagccggctacaacctggaccaagtccttgagcagggcggtgtgtccagtttgtttcagaatctcggggtgtcc
gtaactccgatccaaaggattgtcctgagcggtgaaaacggcctgaagatcgacatccatgtcatcatcccgtatgaa
ggtctgagcggcgatcagatgggccagatcgaaaaaattttttaaggtggtgtaccctgtggatgatcatcacttttaag
gtgattctgcactatggcacactggtaatcgacggggttacgccgaacatgatcgactatttcggacggccgtatgaa
ggcatcgccgtgttcgacggcaaaaagatcactgtaaccgggaccctgtggaacggcaacaaaattatcgacgagcgc
ctgatcaaccccgacggctccctgctgttccgcgtaaccatcaacggagtgaccggctggcggctgtgcgagcgcatt
ttggcgggaagttctggtggaggaagttctggtggagagcctactactgagaacttgtacttccagagcgataacgga
agttctggtggaggaagttctggtggaatggtgtttacactcgaagatttcgtaggg SEQ ID NO: 125 (L27V CP 12 TEV)
QTAGYNLDQVLEQGGVSSLFQNLGVSVTPIQRIVLSGENGLKIDIHVIIPYEGLSGDQMGQIEKIFKVVYPVDDHHFK
VILHYGTLVIDGVTPNMIDYFGRPYEGIAVFDGKKITVTGTLWNGNKIIDERLINPDGSLLFRVTINGVTGWRLCERI
LAGSSGGGSSGGEPTTENLYFQSDNGSSGGGSSGGMVFTLEDFVG SEQ ID NO: 126 (L27V CP 15 TEV)
atgggctacaacctggaccaagtccttgagcagggcggtgtgtccagtttgtttcagaatctcggggtgtccgtaact
ccgatccaaaggattgtcctgagcggtgaaaacggcctgaagatcgacatccatgtcatcatcccgtatgaaggtctg
agcggcgatcagatgggccagatcgaaaaaattttttaaggtggtgtaccctgtggatgatcatcacttttaaggtgatt
ctgcactatggcacactggtaatcgacggggttacgccgaacatgatcgactatttcggacggccgtatgaaggcatc
gccgtgttcgacggcaaaaagatcactgtaaccgggaccctgtggaacggcaacaaaattatcgacgagcgcctgatc
aaccccgacggctccctgctgttccgcgtaaccatcaacggagtgaccggctggcggctgtgcgagcgcattttggcg
ggaagttctggtggaggaagttctggtggagagcctactactgagaacttgtacttccagagcgataacggaagttct
ggtggaggaagttctggtggaatggtgtttacactcgaagatttcgtaggggactggcggcagacagcc SEQ ID NO: 127 (L27V CP 15 TEV)
MGYNLDQVLEQGGVSSLFQNLGVSVTPIQRIVLSGENGLKIDIHVIIPYEGLSGDQMGQIEKIFKVVYPVDDHHFKVI
LHYGTLVIDGVTPNMIDYFGRPYEGIAVFDGKKITVTGTLWNGNKIIDERLINPDGSLLFRVTINGVTGWRLCERILA
GSSGGGSSGGEPTTENLYFQSDNGSSGGGSSGGMVFTLEDFVGDWRQTA SEQ ID NO: 128 (L27V CP 18 TEV)
ctggaccaagtccttgagcagggcggtgtgtccagtttgtttcagaatctcggggtgtccgtaactccgatccaaagg
attgtcctgagcggtgaaaacggcctgaagatcgacatccatgtcatcatcccgtatgaaggtctgagcggcgatcag
atgggccagatcgaaaaaattttttaaggtggtgtaccctgtggatgatcatcacttttaaggtgattctgcactatggc
acactggtaatcgacggggttacgccgaacatgatcgactatttcggacggccgtatgaaggcatcgccgtgttcgac
ggcaaaaagatcactgtaaccgggaccctgtggaacggcaacaaaattatcgacgagcgcctgatcaaccccgacggc
tccctgctgttccgcgtaaccatcaacggagtgaccggctggcggctgtgcgagcgcattttggcgggaagttctggt
ggaggaagttctggtggagagcctactactgagaacttgtacttccagagcgataacggaagttctggtggaggaagt
tctggtggaatggtgtttacactcgaagatttcgtaggggactggcggcagacagccggctacaac SEQ ID NO: 129 (L27V CP 18 TEV)
LDQVLEQGGVSSLFQNLGVSVTPIQRIVLSGENGLKIDIHVIIPYEGLSGDQMGQIEKIFKVVYPVDDHHFKVILHYG
TLVIDGVTPNMIDYFGRPYEGIAVFDGKKITVTGTLWNGNKIIDERLINPDGSLLFRVTINGVTGWRLCERILAGSSG
GGSSGGEPTTENLYFQSDNGSSGGGSSGGMVFTLEDFVGDWRQTAGYN SEQ ID NO: 130 (L27V CP 21 TEV)
gtccttgagcagggcggtgtgtccagtttgtttcagaatctcggggtgtccgtaactccgatccaaaggattgtcctg
agcggtgaaaacggcctgaagatcgacatccatgtcatcatcccgtatgaaggtctgagcggcgatcagatgggccag
atcgaaaaaattttttaaggtggtgtaccctgtggatgatcatcacttttaaggtgattctgcactatggcacactggta
atcgacggggttacgccgaacatgatcgactatttcggacggccgtatgaaggcatcgccgtgttcgacggcaaaaag
atcactgtaaccgggaccctgtggaacggcaacaaaattatcgacgagcgcctgatcaaccccgacggctccctgctg
ttccgcgtaaccatcaacggagtgaccggctggcggctgtgcgagcgcattttggcgggaagttctggtggaggaagt
tctggtggagagcctactactgagaacttgtacttccagagcgataacggaagttctggtggaggaagttctggtgga
atggtgtttacactcgaagatttcgtaggggactggcggcagacagccggctacaacctggaccaa SEQ ID NO: 131 (L27V CP 21 TEV)
VLEQGGVSSLFQNLGVSVTPIQRIVLSGENGLKIDIHVIIPYEGLSGDQMGQIEKIFKVVYPVDDHHFKVILHYGTLV
IDGVTPNMIDYFGRPYEGIAVFDGKKITVTGTLWNGNKIIDERLINPDGSLLFRVTINGVTGWRLCERILAGSSGGGS
SGGEPTTENLYFQSDNGSSGGGSSGGMVFTLEDFVGDWRQTAGYNLDQ SEQ ID NO: 132 (L27V CP 24 TEV)
cagggcggtgtgtccagtttgtttcagaatctcggggtgtccgtaactccgatccaaaggattgtcctgagcggtgaa
aacggcctgaagatcgacatccatgtcatcatcccgtatgaaggtctgagcggcgatcagatgggccagatcgaaaaa
attttttaaggtggtgtaccctgtggatgatcatcacttttaaggtgattctgcactatggcacactggtaatcgacggg
gttacgccgaacatgatcgactatttcggacggccgtatgaaggcatcgccgtgttcgacggcaaaaagatcactgta
accgggaccctgtggaacggcaacaaaattatcgacgagcgcctgatcaaccccgacggctccctgctgttccgcgta accatcaacggagtgaccggctggcggctgtgcgagcgcatttggcgggaagttctggtggaggaagttctggtgga
gagcctactactgagaacttgtacttccagagcgataacggaagttctggtggaggaagttctggtggaatggtgttt
acactcgaagatttcgtaggggactggcggcagacagccggctacaacctggaccaagtccttgag SEQ ID NO: 133 (L27V CP 24 TEV)
QGGVSSLFQNLGVSVTPIQRIVLSGENGLKIDIHVIIPYEGLSGDQMGQIEKIFKVVYPVDDHHFKVILHYGTLVIDG
VTPNMIDYFGRPYEGIAVFDGKKITVTGTLWNGNKIIDERLINPDGSLLFRVTINGVTGWRLCERILAGSSGGGSSGG
EPTTENLYFQSDNGSSGGGSSGGMVFTLEDFVGDWRQTAGYNLDQVLE SEQ ID NO: 134 (L27V CP 27 TEV)
gtgtccagtttgtttcagaatctcggggtgtccgtaactccgatccaaaggattgtcctgagcggtgaaaacggcctg
aagatcgacatccatgtcatcatcccgtatgaaggtctgagcggcgatcagatgggccagatcgaaaaaattttttaag
gtggtgtaccctgtggatgatcatcacttttaaggtgattctgcactatggcacactggtaatcgacggggttacgccg
aacatgatcgactatttcggacggccgtatgaaggcatcgccgtgttcgacggcaaaaagatcactgtaaccgggacc
ctgtggaacggcaacaaaattatcgacgagcgcctgatcaaccccgacggctccctgctgttccgcgtaaccatcaac
ggagtgaccggctggcggctgtgcgagcgcatttggcgggaagttctggtggaggaagttctggtggagagcctact
actgagaacttgtacttccagagcgataacggaagttctggtggaggaagttctggtggaatggtgtttacactcgaa
gatttcgtaggggactggcggcagacagccggctacaacctggaccaagtccttgagcagggcggt SEQ ID NO: 135 (L27V CP 27 TEV)
VSSLFQNLGVSVTPIQRIVLSGENGLKIDIHVIIPYEGLSGDQMGQIEKIFKVVYPVDDHHFKVILHYGTLVIDGVTP
NMIDYFGRPYEGIAVFDGKKITVTGTLWNGNKIIDERLINPDGSLLFRVTINGVTGWRLCERILAGSSGGGSSGGEPT
TENLYFQSDNGSSGGGSSGGMVFTLEDFVGDWRQTAGYNLDQVLEQGG SEQ ID NO: 136 (L27V CP 34 TEV)
atgctcggggtgtccgtaactccgatccaaaggattgtcctgagcggtgaaaacggcctgaagatcgacatccatgtc
atcatcccgtatgaaggtctgagcggcgatcagatgggccagatcgaaaaaattttttaaggtggtgtaccctgtggat
gatcatcacttttaaggtgattctgcactatggcacactggtaatcgacggggttacgccgaacatgatcgactatttc
ggacggccgtatgaaggcatcgccgtgttcgacggcaaaaagatcactgtaaccgggaccctgtggaacggcaacaaa
attatcgacgagcgcctgatcaaccccgacggctccctgctgttccgcgtaaccatcaacggagtgaccggctggcgg
ctgtgcgagcgcatttggcgggaagttctggtggaggaagttctggtggagagcctactactgagaacttgtacttc
cagagcgataacggaagttctggtggaggaagttctggtggaatggtgtttacactcgaagatttcgtaggggactgg
cggcagacagccggctacaacctggaccaagtccttgagcagggcggtgtgtccagtttgtttcagaat SEQ ID NO: 137 (L27V CP 34 TEV)
MLGVSVTPIQRIVLSGENGLKIDIHVIIPYEGLSGDQMGQIEKIFKVVYPVDDHHFKVILHYGTLVIDGVTPNMIDYF
GRPYEGIAVFDGKKITVTGTLWNGNKIIDERLINPDGSLLFRVTINGVTGWRLCERILAGSSGGGSSGGEPTTENLYF
QSDNGSSGGGSSGGMVFTLEDFVGDWRQTAGYNLDQVLEQGGVSSLFQN SEQ ID NO: 138 (L27V CP 40 TEV)
Atgccgatccaaaggattgtcctgagcggtgaaaacggcctgaagatcgacatccatgtcatcatcccgtatgaaggt
ctgagcggcgatcagatgggccagatcgaaaaaattttttaaggtggtgtaccctgtggatgatcatcacttttaaggtg
attctgcactatggcacactggtaatcgacggggttacgccgaacatgatcgactatttcggacggccgtatgaaggc
atcgccgtgttcgacggcaaaaagatcactgtaaccgggaccctgtggaacggcaacaaaattatcgacgagcgcctg
atcaaccccgacggctccctgctgttccgcgtaaccatcaacggagtgaccggctggcggctgtgcgagcgcatttg
gcgggaagttctggtggaggaagttctggtggagagcctactactgagaacttgtacttccagagcgataacggaagt
tctggtggaggaagttctggtggaatggtgtttacactcgaagatttcgtaggggactggcggcagacagccggctac
aacctggaccaagtccttgagcagggcggtgtgtccagtttgtttcagaatctcggggtgtccgtaact SEQ ID NO: 139 (L27V CP 40 TEV)
MPIQRIVLSGENGLKIDIHVIIPYEGLSGDQMGQIEKIFKVVYPVDDHHFKVILHYGTLVIDGVTPNMIDYFGRPYEG
IAVFDGKKITVTGTLWNGNKIIDERLINPDGSLLFRVTINGVTGWRLCERILAGSSGGGSSGGEPTTENLYFQSDNGS
SGGGSSGGMVFTLEDFVGDWRQTAGYNLDQVLEQGGVSSLFQNLGVSVT SEQ ID NO: 140 (L27V CP 43 TEV)
Atgaggattgtcctgagcggtgaaaacggcctgaagatcgacatccatgtcatcatcccgtatgaaggtctgagcggc
gatcagatgggccagatcgaaaaaattttttaaggtggtgtaccctgtggatgatcatcactttaaggtgattctgcac
tatggcacactggtaatcgacggggttacgccgaacatgatcgactatttcggacggccgtatgaaggcatcgccgtg
ttcgacggcaaaaagatcactgtaaccgggaccctgtggaacggcaacaaaattatcgacgagcgcctgatcaaccc
gacggctccctgctgttccgcgtaaccatcaacggagtgaccggctggcggctgtgcgagcgcattttggcgggaagt
tctggtggaggaagttctggtggagagcctactactgagaacttgtacttccagagcgataacggaagttctggtgga
ggaagttctggtggaatggtgtttacactcgaagatttcgtaggggactggcggcagacagccggctacaacctggac
caagtccttgagcagggcggtgtgtccagtttgtttcagaatctcggggtgtccgtaactccgatccaa SEQ ID NO: 141 (L27V CP 43 TEV)
MRIVLSGENGLKIDIHVIIPYEGLSGDQMGQIEKIFKVVYPVDDHHFKVILHYGTLVIDGVTPNMIDYFGRPYEGIAV
FDGKKITVTGTLWNGNKIIDERLINPDGSLLFRVTINGVTGWRLCERILAGSSGGGSSGGEPTTENLYFQSDNGSSGG
GSSGGMVFTLEDFVGDWRQTAGYNLDQVLEQGGVSSLFQNLGVSVTPIQ SEQ ID NO: 142 (L27V CP 44 TEV)
Atgattgtcctgagcggtgaaaacggcctgaagatcgacatccatgtcatcatcccgtatgaaggtctgagcggcgat
cagatgggccagatcgaaaaaattttttaaggtggtgtaccctgtggatgatcatcactttaaggtgattctgcactat
ggcacactggtaatcgacggggttacgccgaacatgatcgactatttcggacggccgtatgaaggcatcgccgtgttc
gacggcaaaaagatcactgtaaccgggaccctgtggaacggcaacaaaattatcgacgagcgcctgatcaaccccgac
ggctccctgctgttccgcgtaaccatcaacggagtgaccggctggcggctgtgcgagcgcatttggcgggaagttct
ggtggaggaagttctggtggagagcctactactgagaacttgtacttccagagcgataacggaagttctggtggagga

SEQUENCE LISTING

```
agttctggtggaatggtgtttacactcgaagatttcgtaggggactggcggcagacagccggctacaacctggaccaa
gtccttgagcagggcggtgtgtccagtttgtttcagaatctcggggtgtccgtaactccgatccaaagg
```

SEQ ID NO: 143 (L27V CP 44 TEV)
MIVLSGENGLKIDIHVIIPYEGLSGDQMGQIEKIFKVVYPVDDHHFKVILHYGTLVIDGVTPNMIDYFGRPYEGIAVF
DGKKITVTGTLWNGNKIIDERLINPDGSLLFRVTINGVTGWRLCERILAGSSGGGSSGGEPTTENLYFQSDNGSSGGG
SSGGMVFTLEDFVGDWRQTAGYNLDQVLEQGGVSSLFQNLGVSVTPIQR

SEQ ID NO: 144 (L27V CP 45 TEV)
```
Atggtcctgagcggtgaaaacggcctgaagatcgacatccatgtcatcatcccgtatgaaggtctgagcggcgatcag
atgggccagatcgaaaaaatttttaaggtggtgtaccctgtggatgatcatcactttaaggtgattctgcactatggc
acactggtaatcgacggggttacgccgaacatgatcgactatttcggacggccgtatgaaggcatcgccgttgtcgac
ggcaaaaagatcactgtaaccgggaccctgtggaacggcaacaaaattatcgacgagcgcctgatcaaccccgacggc
tccctgctgttccgcgtaaccatcaacggagtgaccggctggcggctgtgcgagcgcattttggcgggaagttctggt
ggaggaagttctggtggagagcctactactgagaacttgtacttccagagcgataacggaagttctggtggaggaagt
tctggtggaatggtgtttacactcgaagatttcgtaggggactggcggcagacagccggctacaacctggaccaagtc
cttgagcagggcggtgtgtccagtttgtttcagaatctcggggtgtccgtaactccgatccaaaggatt
```

SEQ ID NO: 145 (L27V CP 45 TEV)
MVLSGENGLKIDIHVIIPYEGLSGDQMGQIEKIFKVVYPVDDHHFKVILHYGTLVIDGVTPNMIDYFGRPYEGIAVFD
GKKITVTGTLWNGNKIIDERLINPDGSLLFRVTINGVTGWRLCERILAGSSGGGSSGGEPTTENLYFQSDNGSSGGGS
SGGMVFTLEDFVGDWRQTAGYNLDQVLEQGGVSSLFQNLGVSVTPIQRI

SEQ ID NO: 146 (L27V CP 46 TEV)
```
Atgctgagcggtgaaaacggcctgaagatcgacatccatgtcatcatcccgtatgaaggtctgagcggcgatcagatg
ggccagatcgaaaaaatttttaaggtggtgtaccctgtggatgatcatcactttaaggtgattctgcactatggcaca
ctggtaatcgacggggttacgccgaacatgatcgactatttcggacggccgtatgaaggcatcgccgttgtcgacggc
aaaaagatcactgtaaccgggaccctgtggaacggcaacaaaattatcgacgagcgcctgatcaaccccgacggctcc
ctgctgttccgcgtaaccatcaacggagtgaccggctggcggctgtgcgagcgcattttggcgggaagttctggtgga
ggaagttctggtggagagcctactactgagaacttgtacttccagagcgataacggaagttctggtggaggaagttct
ggtggaatggtgtttacactcgaagatttcgtaggggactggcggcagacagccggctacaacctggaccaagtccttt
gagcagggcggtgtgtccagtttgtttcagaatctcggggtgtccgtaactccgatccaaaggatt
```

SEQ ID NO: 147 (L27V CP 46 TEV)
MLSGENGLKIDIHVIIPYEGLSGDQMGQIEKIFKVVYPVDDHHFKVILHYGTLVIDGVTPNMIDYFGRPYEGIAVFDG
KKITVTGTLWNGNKIIDERLINPDGSLLFRVTINGVTGWRLCERILAGSSGGGSSGGEPTTENLYFQSDNGSSGGGSS
GGMVFTLEDFVGDWRQTAGYNLDQVLEQGGVSSLFQNLGVSVTPIQRI

SEQ ID NO: 148 (L27V CP 47 TEV)
```
atgagcggtgaaaacggcctgaagatcgacatccatgtcatcatcccgtatgaaggtctgagcggcgatcagatgggc
cagatcgaaaaaatttttaaggtggtgtaccctgtggatgatcatcactttaaggtgattctgcactatggcacactg
gtaatcgacggggttacgccgaacatgatcgactatttcggacggccgtatgaaggcatcgccgttgtcgacgcaaa
aagatcactgtaaccgggaccctgtggaacggcaacaaaattatcgacgagcgcctgatcaaccccgacggctccctg
ctgttccgcgtaaccatcaacggagtgaccggctggcggctgtgcgagcgcattttggcgggaagttctggtggagga
agttctggtggagagcctactactgagaacttgtacttccagagcgataacggaagttctggtggaggaagttctggt
ggaatggtgtttacactcgaagatttcgtaggggactggcggcagacagccggctacaacctggaccaagtccttgag
cagggcggtgtgtccagtttgtttcagaatctcggggtgtccgtaactccgatccaaaggattgtcctg
```

SEQ ID NO: 149 (L27V CP 47 TEV)
MSGENGLKIDIHVIIPYEGLSGDQMGQIEKIFKVVYPVDDHHFKVILHYGTLVIDGVTPNMIDYFGRPYEGIAVFDGK
KITVTGTLWNGNKIIDERLINPDGSLLFRVTINGVTGWRLCERILAGSSGGGSSGGEPTTENLYFQSDNGSSGGGSSG
GMVFTLEDFVGDWRQTAGYNLDQVLEQGGVSSLFQNLGVSVTPIQRIVL

SEQ ID NO: 150 (L27V CP 48 TEV)
```
atgggtgaaaacggcctgaagatcgacatccatgtcatcatcccgtatgaaggtctgagcggcgatcagatgggccag
atcgaaaaaatttttaaggtggtgtaccctgtggatgatcatcactttaaggtgattctgcactatggcacactggta
atcgacggggttacgccgaacatgatcgactatttcggacggccgtatgaaggcatcgccgttgtcgacggcaaaaag
atcactgtaaccgggaccctgtggaacggcaacaaaattatcgacgagcgcctgatcaaccccgacggctccctgctg
ttccgcgtaaccatcaacggagtgaccggctggcggctgtgcgagcgcattttggcgggaagttctggtggaggaagt
tctggtggagagcctactactgagaacttgtacttccagagcgataacggaagttctggtggaggaagttctggtgga
atggtgtttacactcgaagatttcgtaggggactggcggcagacagccggctacaacctggaccaagtccttgagcag
ggcggtgtgtccagtttgtttcagaatctcggggtgtccgtaactccgatccaaaggattgtcctgagcg
```

SEQ ID NO: 151 (L27V CP 48 TEV)
MGENGLKIDIHVIIPYEGLSGDQMGQIEKIFKVVYPVDDHHFKVILHYGTLVIDGVTPNMIDYFGRPYEGIAVFDGKK
ITVTGTLWNGNKIIDERLINPDGSLLFRVTINGVTGWRLCERILAGSSGGGSSGGEPTTENLYFQSDNGSSGGGSSGG
MVFTLEDFVGDWRQTAGYNLDQVLEQGGVSSLFQNLGVSVTPIQRIVLS

SEQ ID NO: 152 (L27V CP 49 TEV)
```
atggaaaacggcctgaagatcgacatccatgtcatcatcccgtatgaaggtctgagcggcgatcagatgggccagatc
gaaaaaatttttaaggtggtgtaccctgtggatgatcatcactttaaggtgattctgcactatggcacactggtaatc
gacggggttacgccgaacatgatcgactatttcggacggccgtatgaaggcatcgccgttgtcgacggcaaaaagatc
actgtaaccgggaccctgtggaacggcaacaaaattatcgacgagcgcctgatcaaccccgacggctccctgctgttc
cgcgtaaccatcaacggagtgaccggctggcggctgtgcgagcgcattttggcgggaagttctggtggaggaagttct
ggtggagagcctactactgagaacttgtacttccagagcgataacggaagttctggtggaggaagttctggtggaatg
gtgtttacactcgaagatttcgtaggggactggcggcagacagccggctacaacctggaccaagtccttgagcagggc
ggtgtgtccagtttgtttcagaatctcggggtgtccgtaactccgatccaaaggattgtcctgagcggt
```

SEQUENCE LISTING

SEQ ID NO: 153 (L27V CP 49 TEV)
MENGLKIDIHVIIPYEGLSGDQMGQIEKIFKVVYPVDDHHFKVILHYGTLVIDGVTPNMIDYFGRPYEGIAVFDGKKI
TVTGTLWNGNKIIDERLINPDGSLLFRVTINGVTGWRLCERILAGSSGGGSSGGEPTTENLYFQSDNGSSGGGSSGGM
VFTLEDFVGDWRQTAGYNLDQVLEQGGVSSLFQNLGVSVTPIQRIVLSG

SEQ ID NO: 154 (L27V CP 50 TEV)
atgaacggcctgaagatcgacatccatgtcatcatcccgtatgaaggtctgagcggcgatcagatgggccagatcgaa
aaaattttaaggtggtgtaccctgtggatgatcatcactttaaggtgattctgcactatggcacactggtaatcgac
ggggttacgccgaacatgatcgactatttcggacggccgtatgaaggcatcgccgtgttcgacggcaaaaagatcact
gtaaccgggaccctgtggaacggcaacaaaattatcgacgagcgcctgatcaaccccgacggctccctgctgttccgc
gtaaccatcaacggagtgaccggctggcggctgtgcgagcgcattttggcgggaagttctggtggaggaagttctggt
ggagagcctactactgagaacttgtacttccagagcgataacggaagttctggtggaggaagttctggtggaatggtg
tttacactcgaagatttcgtaggggactggcggcagacagccggctacaacctggaccaagtccttgagcagggcggt
gtgtccagtttgttcagaatctcggggtgtccgtaactccgatccaaaggattgtcctgagcggtgaa SEQ ID NO: 155 (L27V CP 50 TEV)
MNGLKIDIHVIIPYEGLSGDQMGQIEKIFKVVYPVDDHHFKVILHYGTLVIDGVTPNMIDYFGRPYEGIAVFDGKKIT
VTGTLWNGNKIIDERLINPDGSLLFRVTINGVTGWRLCERILAGSSGGGSSGGEPTTENLYFQSDNGSSGGGSSGGMV
FTLEDFVGDWRQTAGYNLDQVLEQGGVSSLFQNLGVSVTPIQRIVLSGE SEQ ID NO: 156 (L27V CP 51 TEV)
atgggcctgaagatcgacatccatgtcatcatcccgtatgaaggtctgagcggcgatcagatgggccagatcgaaaaa
attttaaggtggtgtaccctgtggatgatcatcactttaaggtgattctgcactatggcacactggtaatcgacggg
gttacgccgaacatgatcgactatttcggacggccgtatgaaggcatcgccgtgttcgacggcaaaaagatcactgta
accgggaccctgtggaacggcaacaaaattatcgacgagcgcctgatcaaccccgacggctccctgctgttccgcgta
accatcaacggagtgaccggctggcggctgtgcgagcgcattttggcgggaagttctggtggaggaagttctggtgga
gagcctactactgagaacttgtacttccagagcgataacggaagttctggtggaggaagttctggtggaatggtgttt
acactcgaagatttcgtaggggactggcggcagacagccggctacaacctggaccaagtccttgagcagggcggtgtg
tccagtttgtttcagaatctcggggtgtccgtaactccgatccaaaggattgtcctgagcggtgaaaac SEQ ID NO: 157 (L27V CP 51 TEV)
MGLKIDIHVIIPYEGLSGDQMGQIEKIFKVVYPVDDHHFKVILHYGTLVIDGVTPNMIDYFGRPYEGIAVFDGKKITV
TGTLWNGNKIIDERLINPDGSLLFRVTINGVTGWRLCERILAGSSGGGSSGGEPTTENLYFQSDNGSSGGGSSGGMVF
TLEDFVGDWRQTAGYNLDQVLEQGGVSSLFQNLGVSVTPIQRIVLSGEN SEQ ID NO: 158 (L27V CP 52 TEV)
atgctgaagatcgacatccatgtcatcatcccgtatgaaggtctgagcggcgatcagatgggccagatcgaaaaaatt
tttaaggtggtgtaccctgtggatgatcatcactttaaggtgattctgcactatggcacactggtaatcgacggggtt
acgccgaacatgatcgactatttcggacggccgtatgaaggcatcgccgtgttcgacggcaaaaagatcactgtaacc
gggaccctgtggaacggcaacaaaattatcgacgagcgcctgatcaaccccgacggctccctgctgttccgcgtaacc
atcaacggagtgaccggctggcggctgtgcgagcgcattttggcgggaagttctggtggaggaagttctggtggagag
cctactactgagaacttgtacttccagagcgataacggaagttctggtggaggaagttctggtggaatggtgtttaca
ctcgaagatttcgtaggggactggcggcagacagccggctacaacctggaccaagtccttgagcagggcggtgtgtcc
agtttgtttcagaatctcggggtgtccgtaactccgatccaaaggattgtcctgagcggtgaaaacggc SEQ ID NO: 159 (L27V CP 52 TEV)
MLKIDIHVIIPYEGLSGDQMGQIEKIFKVVYPVDDHHFKVILHYGTLVIDGVTPNMIDYFGRPYEGIAVFDGKKITVT
GTLWNGNKIIDERLINPDGSLLFRVTINGVTGWRLCERILAGSSGGGSSGGEPTTENLYFQSDNGSSGGGSSGGMVFT
LEDFVGDWRQTAGYNLDQVLEQGGVSSLFQNLGVSVTPIQRIVLSGENG SEQ ID NO: 160 (L27V CP 53 TEV)
atgaagatcgacatccatgtcatcatcccgtatgaaggtctgagcggcgatcagatgggccagatcgaaaaaattttt
aaggtggtgtaccctgtggatgatcatcactttaaggtgattctgcactatggcacactggtaatcgacggggttacg
ccgaacatgatcgactatttcggacggccgtatgaaggcatcgccgtgttcgacggcaaaaagatcactgtaaccggg
accctgtggaacggcaacaaaattatcgacgagcgcctgatcaaccccgacggctccctgctgttccgcgtaaccatc
aacggagtgaccggctggcggctgtgcgagcgcattttggcgggaagttctggtggaggaagttctggtggagagcct
actactgagaacttgtacttccagagcgataacggaagttctggtggaggaagttctggtggaatggtgtttacactc
gaagatttcgtaggggactggcggcagacagccggctacaacctggaccaagtccttgagcagggcggtgtgtccagt
ttgtttcagaatctcggggtgtccgtaactccgatccaaaggattgtcctgagcggtgaaaacggcctg SEQ ID NO: 161 (L27V CP 53 TEV)
MKIDIHVIIPYEGLSGDQMGQIEKIFKVVYPVDDHHFKVILHYGTLVIDGVTPNMIDYFGRPYEGIAVFDGKKITVTG
TLWNGNKIIDERLINPDGSLLFRVTINGVTGWRLCERILAGSSGGGSSGGEPTTENLYFQSDNGSSGGGSSGGMVFTL
EDFVGDWRQTAGYNLDQVLEQGGVSSLFQNLGVSVTPIQRIVLSGENGL SEQ ID NO: 162 (L27V CP 54 TEV)
atgatcgacatccatgtcatcatcccgtatgaaggtctgagcggcgatcagatgggccagatcgaaaaaattttaag
gtggtgtaccctgtggatgatcatcactttaaggtgattctgcactatggcacactggtaatcgacggggttacgccg
aacatgatcgactatttcggacggccgtatgaaggcatcgccgtgttcgacggcaaaaagatcactgtaaccgggacc
ctgtggaacggcaacaaaattatcgacgagcgcctgatcaaccccgacggctccctgctgttccgcgtaaccatcaac
ggagtgaccggctggcggctgtgcgagcgcattttggcgggaagttctggtggaggaagttctggtggagagcctact
actgagaacttgtacttccagagcgataacggaagttctggtggaggaagttctggtggaatggtgtttacactcgaa
gatttcgtaggggactggcggcagacagccggctacaacctggaccaagtccttgagcagggcggtgtgtccagtttg
tttcagaatctcggggtgtccgtaactccgatccaaaggattgtcctgagcggtgaaaacggcctgaag

SEQUENCE LISTING

SEQ ID NO: 163 (L27V CP 54 TEV)
MIDIHVIIPYEGLSGDQMGQIEKIFKVVYPVDDHHFKVILHYGTLVIDGVTPNMIDYFGRPYEGIAVFDGKKITVTGT
LWNGNKIIDERLINPDGSLLFRVTINGVTGWRLCERILAGSSGGGSSGGEPTTENLYFQSDNGSSGGGSSGGMVFTLE
DFVGDWRQTAGYNLDQVLEQGGVSSLFQNLGVSVTPIQRIVLSGENGLK

SEQ ID NO: 164 (L27V CP 55 TEV)
atggacatccatgtcatcatcccgtatgaaggtctgagcggcgatcagatgggccagatcgaaaaaattttttaaggtg
gtgtaccctgtggatgatcatcactttaaggtgattctgcactatggcacactggtaatcgacggggttacgccgaac
atgatcgactatttcggacggccgtatgaaggcatcgccgtgttcgacggcaaaaagatcactgtaaccgggaccctg
tggaacggcaacaaaattatcgacgagcgcctgatcaaccccgacggctccctgctgttccgcgtaaccatcaacgga
gtgaccggctggcggctgtgcgagcgcatttttggcgggaagttctggtggaggaagttctggtggagagcctactact
gagaacttgtacttccagagcgataacggaagttctggtggaggaagttctggtggaatggtgtttacactcgaagat
ttcgtagggggactggcggcagacagccggctacaacctggaccaagtccttgagcagggcggtgtgtccagtttgttt
cagaatctcggggtgtccgtaactccgatccaaaggattgtcctgagcggtgaaaacggcctgaagatc SEQ ID NO: 165 (L27V CP 55 TEV)
MDIHVIIPYEGLSGDQMGQIEKIFKVVYPVDDHHFKVILHYGTLVIDGVTPNMIDYFGRPYEGIAVFDGKKITVTGTL
WNGNKIIDERLINPDGSLLFRVTINGVTGWRLCERILAGSSGGGSSGGEPTTENLYFQSDNGSSGGGSSGGMVFTLED
FVGDWRQTAGYNLDQVLEQGGVSSLFQNLGVSVTPIQRIVLSGENGLKI SEQ ID NO: 166 (L27V CP 56 TEV)
Atgatccatgtcatcatcccgtatgaaggtctgagcggcgatcagatgggccagatcgaaaaaattttttaaggtggtg
taccctgtggatgatcatcactttaaggtgattctgcactatggcacactggtaatcgacggggttacgccgaacatg
atcgactatttcggacggccgtatgaaggcatcgccgtgttcgacggcaaaaagatcactgtaaccgggaccctgtgg
aacggcaacaaaattatcgacgagcgcctgatcaaccccgacggctccctgctgttccgcgtaaccatcaacggagtg
accggctggcggctgtgcgagcgcatttttggcgggaagttctggtggaggaagttctggtggagagcctactactgag
aacttgtacttccagagcgataacggaagttctggtggaggaagttctggtggaatggtgtttacactcgaagatttc
gtagggggactggcggcagacagccggctacaacctggaccaagtccttgagcagggcggtgtgtccagtttgtttcag
aatctcggggtgtccgtaactccgatccaaaggattgtcctgagcggtgaaaacggcctgaagatcga SEQ ID NO: 167 (L27V CP 56 TEV)
MIHVIIPYEGLSGDQMGQIEKIFKVVYPVDDHHFKVILHYGTLVIDGVTPNMIDYFGRPYEGIAVFDGKKITVTGTLW
NGNKIIDERLINPDGSLLFRVTINGVTGWRLCERILAGSSGGGSSGGEPTTENLYFQSDNGSSGGGSSGGMVFTLEDF
VGDWRQTAGYNLDQVLEQGGVSSLFQNLGVSVTPIQRIVLSGENGLKID SEQ ID NO: 168 (L27V CP 58 TEV)
atggtcatcatcccgtatgaaggtctgagcggcgatcagatgggccagatcgaaaaaattttttaaggtggtgtaccct
gtggatgatcatcactttaaggtgattctgcactatggcacactggtaatcgacggggttacgccgaacatgatcgac
tatttcggacggccgtatgaaggcatcgccgtgttcgacggcaaaaagatcactgtaaccgggaccctgtggaacggc
aacaaaattatcgacgagcgcctgatcaaccccgacggctccctgctgttccgcgtaaccatcaacggagtgaccggc
tggcggctgtgcgagcgcatttttggcgggaagttctggtggaggaagttctggtggagagcctactactgagaacttg
tacttccagagcgataacggaagttctggtggaggaagttctggtggaatggtgtttacactcgaagatttcgtaggg
gactggcggcagacagccggctacaacctggaccaagtccttgagcagggcggtgtgtccagtttgtttcagaatctc
ggggtgtccgtaactccgatccaaaggattgtcctgagcggtgaaaacggcctgaagatcgacatccat SEQ ID NO: 169 (L27V CP 58 TEV)
MVIIPYEGLSGDQMGQIEKIFKVVYPVDDHHFKVILHYGTLVIDGVTPNMIDYFGRPYEGIAVFDGKKITVTGTLWNG
NKIIDERLINPDGSLLFRVTINGVTGWRLCERILAGSSGGGSSGGEPTTENLYFQSDNGSSGGGSSGGMVFTLEDFVG
DWRQTAGYNLDQVLEQGGVSSLFQNLGVSVTPIQRIVLSGENGLKIDIH SEQ ID NO: 170 (L27V CP 64 TEV)
atgggtctgagcggcgatcagatgggccagatcgaaaaaattttttaaggtggtgtaccctgtggatgatcatcacttt
aaggtgattctgcactatggcacactggtaatcgacggggttacgccgaacatgatcgactatttcggacggccgtat
gaaggcatcgccgtgttcgacggcaaaaagatcactgtaaccgggaccctgtggaacggcaacaaaattatcgacgag
cgcctgatcaaccccgacggctccctgctgttccgcgtaaccatcaacggagtgaccggctggcggctgtgcgagcgc
atttttggcgggaagttctggtggaggaagttctggtggagagcctactactgagaacttgtacttccagagcgataac
ggaagttctggtggaggaagttctggtggaatggtgtttacactcgaagatttcgtagggggactggcggcagacagcc
ggctacaacctggaccaagtccttgagcagggcggtgtgtccagtttgtttcagaatctcggggtgtccgtaactccg
atccaaaggattgtcctgagcggtgaaaacggcctgaagatcgacatccatgtcatcatcccgtatgaa SEQ ID NO: 171 (L27V CP 64 TEV)
MGLSGDQMGQIEKIFKVVYPVDDHHFKVILHYGTLVIDGVTPNMIDYFGRPYEGIAVFDGKKITVTGTLWNGNKIIDE
RLINPDGSLLFRVTINGVTGWRLCERILAGSSGGGSSGGEPTTENLYFQSDNGSSGGGSSGGMVFTLEDFVGDWRQTA
GYNLDQVLEQGGVSSLFQNLGVSVTPIQRIVLSGENGLKIDIHVIIPYE SEQ ID NO: 172 (L27V CP 67 TEV)
atgggcgatcagatgggccagatcgaaaaaattttttaaggtggtgtaccctgtggatgatcatcactttaaggtgatt
ctgcactatggcacactggtaatcgacggggttacgccgaacatgatcgactatttcggacggccgtatgaaggcatc
gccgtgttcgacggcaaaaagatcactgtaaccgggaccctgtggaacggcaacaaaattatcgacgagcgcctgatc
aaccccgacggctccctgctgttccgcgtaaccatcaacggagtgaccggctggcggctgtgcgagcgcatttttggcg
ggaagttctggtggaggaagttctggtggagagcctactactgagaacttgtacttccagagcgataacggaagttct
ggtggaggaagttctggtggaatggtgtttacactcgaagatttcgtagggggactggcggcagacagccggctacaac
ctggaccaagtccttgagcagggcggtgtgtccagtttgtttcagaatctcggggtgtccgtaactccgatccaaagg
attgtcctgagcggtgaaaacggcctgaagatcgacatccatgtcatcatcccgtatgaaggtctgagc

SEQUENCE LISTING

SEQ ID NO: 173 (L27V CP 67 TEV)
MGDQMGQIEKIFKVVYPVDDHHFKVILHYGTLVIDGVTPNMIDYFGRPYEGIAVFDGKKITVTGTLWNGNKIIDERLI
NPDGSLLFRVTINGVTGWRLCERILAGSSGGGSSGGEPTTENLYFQSDNGSSGGGSSGGMVFTLEDFVGDWRQTAGYN
LDQVLEQGGVSSLFQNLGVSVTPIQRIVLSGENGLKIDIHVIIPYEGLS

SEQ ID NO: 174 (L27V CP 70 TEV)
atgatgggccagatcgaaaaaattttttaaggtggtgtaccctgtggatgatcatcactttaaggtgattctgcactat
ggcacactggtaatcgacggggttacgccgaacatgatcgactatttcggacggccgtatgaaggcatcgccgtgttc
gacggcaaaaagatcactgtaaccgggaccctgtggaacggcaacaaaattatcgacgagcgcctgatcaaccccgac
ggctccctgctgttccgcgtaaccatcaacggagtgaccggctggcggctgtgcgagcgcattttggcgggaagttct
ggtggaggaagttctggtggagagcctactactgagaacttgtacttccagagcgataacggaagttctggtggagga
agttctggtggaatggtgtttacactcgaagatttcgtaggggactggcggcagacagccggctacaacctggaccaa
gtccttgagcagggcggtgtgtccagtttgtttcagaatctcggggtgtccgtaactccgatccaaaggattgtcctg
agcggtgaaaacggcctgaagatcgacatccatgtcatcatcccgtatgaaggtctgagcggcgatcag SEQ ID NO: 175 (L27V CP 70 TEV)
MMGQIEKIFKVVYPVDDHHFKVILHYGTLVIDGVTPNMIDYFGRPYEGIAVFDGKKITVTGTLWNGNKIIDERLINPD
GSLLFRVTINGVTGWRLCERILAGSSGGGSSGGEPTTENLYFQSDNGSSGGGSSGGMVFTLEDFVGDWRQTAGYNLDQ
VLEQGGVSSLFQNLGVSVTPIQRIVLSGENGLKIDIHVIIPYEGLSGDQ SEQ ID NO: 176 (L27V CP 73 TEV)
atgatcgaaaaaattttttaaggtggtgtaccctgtggatgatcatcactttaaggtgattctgcactatggcacactg
gtaatcgacggggttacgccgaacatgatcgactatttcggacggccgtatgaaggcatcgccgtgttcgacggcaaa
aagatcactgtaaccgggaccctgtggaacggcaacaaaattatcgacgagcgcctgatcaaccccgacggctccctg
ctgttccgcgtaaccatcaacggagtgaccggctggcggctgtgcgagcgcattttggcgggaagttctggtggagga
agttctggtggagagcctactactgagaacttgtacttccagagcgataacggaagttctggtggaggaagttctggt
ggaatggtgtttacactcgaagatttcgtaggggactggcggcagacagccggctacaacctggaccaagtccttgag
cagggcggtgtgtccagtttgtttcagaatctcggggtgtccgtaactccgatccaaaggattgtcctgagcggtgaa
aacggcctgaagatcgacatccatgtcatcatcccgtatgaaggtctgagcggcgatcagatgggccag SEQ ID NO: 177 (L27V CP 73 TEV)
MIEKIFKVVYPVDDHHFKVILHYGTLVIDGVTPNMIDYFGRPYEGIAVFDGKKITVTGTLWNGNKIIDERLINPDGSL
LFRVTINGVTGWRLCERILAGSSGGGSSGGEPTTENLYFQSDNGSSGGGSSGGMVFTLEDFVGDWRQTAGYNLDQVLE
QGGVSSLFQNLGVSVTPIQRIVLSGENGLKIDIHVIIPYEGLSGDQMGQ SEQ ID NO: 178 (L27V CP 76 TEV)
atgattttttaaggtggtgtaccctgtggatgatcatcactttaaggtgattctgcactatggcacactggtaatcgac
ggggttacgccgaacatgatcgactatttcggacggccgtatgaaggcatcgccgtgttcgacggcaaaaagatcact
gtaaccgggaccctgtggaacggcaacaaaattatcgacgagcgcctgatcaaccccgacggctccctgctgttccgc
gtaaccatcaacggagtgaccggctggcggctgtgcgagcgcattttggcgggaagttctggtggaggaagttctggt
ggagagcctactactgagaacttgtacttccagagcgataacggaagttctggtggaggaagttctggtggaatggtg
tttacactcgaagatttcgtaggggactggcggcagacagccggctacaacctggaccaagtccttgagcagggcggt
gtgtccagtttgtttcagaatctcggggtgtccgtaactccgatccaaaggattgtcctgagcggtgaaaacggcctg
aagatcgacatccatgtcatcatcccgtatgaaggtctgagcggcgatcagatgggccagatcgaaaaa SEQ ID NO: 179 (L27V CP 76 TEV)
MIFKVVYPVDDHHFKVILHYGTLVIDGVTPNMIDYFGRPYEGIAVFDGKKITVTGTLWNGNKIIDERLINPDGSLLFR
VTINGVTGWRLCERILAGSSGGGSSGGEPTTENLYFQSDNGSSGGGSSGGMVFTLEDFVGDWRQTAGYNLDQVLEQGG
VSSLFQNLGVSVTPIQRIVLSGENGLKIDIHVIIPYEGLSGDQMGQIEK SEQ ID NO: 180 (L27V CP 79 TEV)
Atggtggtgtaccctgtggatgatcatcactttaaggtgattctgcactatggcacactggtaatcgacggggttacg
ccgaacatgatcgactatttcggacggccgtatgaaggcatcgccgtgttcgacggcaaaaagatcactgtaaccggg
accctgtggaacggcaacaaaattatcgacgagcgcctgatcaaccccgacggctccctgctgttccgcgtaaccatc
aacggagtgaccggctggcggctgtgcgagcgcattttggcgggaagttctggtggaggaagttctggtggagagcct
actactgagaacttgtacttccagagcgataacggaagttctggtggaggaagttctggtggaatggtgtttacactc
gaagatttcgtaggggactggcggcagacagccggctacaacctggaccaagtccttgagcagggcggtgtgtccagt
ttgtttcagaatctcggggtgtccgtaactccgatccaaaggattgtcctgagcggtgaaaacggcctgaagatcgac
atccatgtcatcatcccgtatgaaggtctgagcggcgatcagatgggccagatcgaaaaaattttttaag SEQ ID NO: 181 (L27V CP 79 TEV)
MVVYPVDDHHFKVILHYGTLVIDGVTPNMIDYFGRPYEGIAVFDGKKITVTGTLWNGNKIIDERLINPDGSLLFRVTI
NGVTGWRLCERILAGSSGGGSSGGEPTTENLYFQSDNGSSGGGSSGGMVFTLEDFVGDWRQTAGYNLDQVLEQGGVSS
LFQNLGVSVTPIQRIVLSGENGLKIDIHVIIPYEGLSGDQMGQIEKIFK SEQ ID NO: 182 (L27V CP 80 TEV)
atggtgtaccctgtggatgatcatcactttaaggtgattctgcactatggcacactggtaatcgacggggttacgccg
aacatgatcgactatttcggacggccgtatgaaggcatcgccgtgttcgacggcaaaaagatcactgtaaccgggacc
ctgtggaacggcaacaaaattatcgacgagcgcctgatcaaccccgacggctccctgctgttccgcgtaaccatcaac
ggagtgaccggctggcggctgtgcgagcgcattttggcgggaagttctggtggaggaagttctggtggagagcctact
actgagaacttgtacttccagagcgataacggaagttctggtggaggaagttctggtggaatggtgtttacactcgaa
gatttcgtaggggactggcggcagacagccggctacaacctggaccaagtccttgagcagggcggtgtgtccagtttg
tttcagaatctcggggtgtccgtaactccgatccaaaggattgtcctgagcggtgaaaacggcctgaagatcgacatc
catgtcatcatcccgtatgaaggtctgagcggcgatcagatgggccagatcgaaaaaattttttaaggtg

SEQUENCE LISTING

SEQ ID NO: 183 (L27V CP 80 TEV)
MVYPVDDHHFKVILHYGTLVIDGVTPNMIDYFGRPYEGIAVFDGKKITVTGTLWNGNKIIDERLINPDGSLLFRVTIN
GVTGWRLCERILAGSSGGGSSGGEPTTENLYFQSDNGSSGGGSSGGMVFTLEDFVGDWRQTAGYNLDQVLEQGGVSSL
FQNLGVSVTPIQRIVLSGENGLKIDIHVIIPYEGLSGDQMGQIEKIFKV

SEQ ID NO: 184 (L27V CP 81 TEV)
atgtaccctgtggatgatcatcactttaaggtgattctgcactatggcacactggtaatcgacggggttacgccgaac
atgatcgactatttcggacggccgtatgaaggcatcgccgtgttcgacggcaaaaagatcactgtaaccgggaccctg
tggaacggcaacaaaattatcgacgagcgcctgatcaaccccgacggctccctgctgttccgcgtaaccatcaacgga
gtgaccggctggcggctgtgcgagcgcattttggcgggaagttctggtggaggaagttctggtggagagcctactact
gagaacttgtacttccagagcgataacggaagttctggtggaggaagttctggtggaatggtgtttacactcgaagat
ttcgtaggggactggcggcagacagccggctacaacctggaccaagtccttgagcagggcggtgtgtccagtttgttt
cagaatctcggggtgtccgtaactccgatccaaaggattgtcctgagcggtgaaaacggcctgaagatcgacatccat
gtcatcatcccgtatgaaggtctgagcggcgatcagatgggccagatcgaaaaaattttttaaggtggtg SEQ ID NO: 185 (L27V CP 81 TEV)
MYPVDDHHFKVILHYGTLVIDGVTPNMIDYFGRPYEGIAVFDGKKITVTGTLWNGNKIIDERLINPDGSLLFRVTING
VTGWRLCERILAGSSGGGSSGGEPTTENLYFQSDNGSSGGGSSGGMVFTLEDFVGDWRQTAGYNLDQVLEQGGVSSLF
QNLGVSVTPIQRIVLSGENGLKIDIHVIIPYEGLSGDQMGQIEKIFKVV SEQ ID NO: 186 (L27V CP 82 TEV)
atgcctgtggatgatcatcactttaaggtgattctgcactatggcacactggtaatcgacggggttacgccgaacatg
atcgactatttcggacggccgtatgaaggcatcgccgtgttcgacggcaaaaagatcactgtaaccgggaccctgtgg
aacggcaacaaaattatcgacgagcgcctgatcaaccccgacggctccctgctgttccgcgtaaccatcaacggagtg
accggctggcggctgtgcgagcgcattttggcgggaagttctggtggaggaagttctggtggagagcctactactgag
aacttgtacttccagagcgataacggaagttctggtggaggaagttctggtggaatggtgtttacactcgaagatttc
gtaggggactggcggcagacagccggctacaacctggaccaagtccttgagcagggcggtgtgtccagtttgtttcag
aatctcggggtgtccgtaactccgatccaaaggattgtcctgagcggtgaaaacggcctgaagatcgacatccatgtc
atcatcccgtatgaaggtctgagcggcgatcagatgggccagatcgaaaaaattttttaaggtggtgtac SEQ ID NO: 187 (L27V CP 82 TEV)
MPVDDHHFKVILHYGTLVIDGVTPNMIDYFGRPYEGIAVFDGKKITVTGTLWNGNKIIDERLINPDGSLLFRVTINGV
TGWRLCERILAGSSGGGSSGGEPTTENLYFQSDNGSSGGGSSGGMVFTLEDFVGDWRQTAGYNLDQVLEQGGVSSLFQ
NLGVSVTPIQRIVLSGENGLKIDIHVIIPYEGLSGDQMGQIEKIFKVVY SEQ ID NO: 188 (L27V CP 83 TEV)
atggtggatgatcatcactttaaggtgattctgcactatggcacactggtaatcgacggggttacgccgaacatgatc
gactatttcggacggccgtatgaaggcatcgccgtgttcgacggcaaaaagatcactgtaaccgggaccctgtggaac
ggcaacaaaattatcgacgagcgcctgatcaaccccgacggctccctgctgttccgcgtaaccatcaacggagtgacc
ggctggcggctgtgcgagcgcattttggcgggaagttctggtggaggaagttctggtggagagcctactactgagaac
ttgtacttccagagcgataacggaagttctggtggaggaagttctggtggaatggtgtttacactcgaagatttcgta
ggggactggcggcagacagccggctacaacctggaccaagtccttgagcagggcggtgtgtccagtttgtttcagaat
ctcggggtgtccgtaactccgatccaaaggattgtcctgagcggtgaaaacggcctgaagatcgacatccatgtcatc
atcccgtatgaaggtctgagcggcgatcagatgggccagatcgaaaaaattttttaaggtggtgtaccct SEQ ID NO: 189 (L27V CP 83 TEV)
MVDDHHFKVILHYGTLVIDGVTPNMIDYFGRPYEGIAVFDGKKITVTGTLWNGNKIIDERLINPDGSLLFRVTINGVT
GWRLCERILAGSSGGGSSGGEPTTENLYFQSDNGSSGGGSSGGMVFTLEDFVGDWRQTAGYNLDQVLEQGGVSSLFQN
LGVSVTPIQRIVLSGENGLKIDIHVIIPYEGLSGDQMGQIEKIFKVVYP SEQ ID NO: 190 (L27V CP 84 TEV)
atggatgatcatcactttaaggtgattctgcactatggcacactggtaatcgacggggttacgccgaacatgatcgac
tatttcggacggccgtatgaaggcatcgccgtgttcgacggcaaaaagatcactgtaaccgggaccctgtggaacggc
aacaaaattatcgacgagcgcctgatcaaccccgacggctccctgctgttccgcgtaaccatcaacggagtgaccggc
tggcggctgtgcgagcgcattttggcgggaagttctggtggaggaagttctggtggagagcctactactgagaacttg
tacttccagagcgataacggaagttctggtggaggaagttctggtggaatggtgtttacactcgaagatttcgtaggg
gactggcggcagacagccggctacaacctggaccaagtccttgagcagggcggtgtgtccagtttgtttcagaatctc
ggggtgtccgtaactccgatccaaaggattgtcctgagcggtgaaaacggcctgaagatcgacatccatgtcatcatc
ccgtatgaaggtctgagcggcgatcagatgggccagatcgaaaaaattttttaaggtggtgtaccctgtg SEQ ID NO: 191 (L27V CP 84 TEV)
MDDHHFKVILHYGTLVIDGVTPNMIDYFGRPYEGIAVFDGKKITVTGTLWNGNKIIDERLINPDGSLLFRVTINGVTG
WRLCERILAGSSGGGSSGGEPTTENLYFQSDNGSSGGGSSGGMVFTLEDFVGDWRQTAGYNLDQVLEQGGVSSLFQNL
GVSVTPIQRIVLSGENGLKIDIHVIIPYEGLSGDQMGQIEKIFKVVYPV SEQ ID NO: 192 (L27V CP 85 TEV)
atggatcatcactttaaggtgattctgcactatggcacactggtaatcgacggggttacgccgaacatgatcgactat
ttcggacggccgtatgaaggcatcgccgtgttcgacggcaaaaagatcactgtaaccgggaccctgtggaacggcaac
aaaattatcgacgagcgcctgatcaaccccgacggctccctgctgttccgcgtaaccatcaacggagtgaccggctgg
cggctgtgcgagcgcattttggcgggaagttctggtggaggaagttctggtggagagcctactactgagaacttgtac
ttccagagcgataacggaagttctggtggaggaagttctggtggaatggtgtttacactcgaagatttcgtaggggac
tggcggcagacagccggctacaacctggaccaagtccttgagcagggcggtgtgtccagtttgtttcagaatctcggg

SEQUENCE LISTING

```
gtgtccgtaactccgatccaaaggattgtcctgagcggtgaaaacggcctgaagatcgacatccatgtcatcatcccg
tatgaaggtctgagcggcgatcagatgggccagatcgaaaaaattttttaaggtggtgtaccctgtggat
```

SEQ ID NO: 193 (L27V CP 85 TEV)
MDHHFKVILHYGTLVIDGVTPNMIDYFGRPYEGIAVFDGKKITVTGTLWNGNKIIDERLINPDGSLLFRVTINGVTGW
RLCERILAGSSGGGSSGGEPTTENLYFQSDNGSSGGGSSGGMVFTLEDFVGDWRQTAGYNLDQVLEQGGVSSLFQNLG
VSVTPIQRIVLSGENGLKIDIHVIIPYEGLSGDQMGQIEKIFKVVYPVD

SEQ ID NO: 194 (L27V CP 86 TEV)
```
atgcatcactttaaggtgattctgcactatggcacactggtaatcgacggggttacgccgaacatgatcgactatttc
ggacggccgtatgaaggcatcgccgtgttcgacggcaaaaagatcactgtaaccgggaccctgtggaacggcaacaaa
attatcgacgagcgcctgatcaaccccgacggctccctgctgttccgcgtaaccatcaacggagtgaccggctggcgg
ctgtgcgagcgcattttggcgggaagttctggtggaggaagttctggtggagagcctactactgagaacttgtacttc
cagagcgataacggaagttctggtggaggaagttctggtggaatggtgtttacactcgaagatttcgtagggactgg
cggcagacagccggctacaacctggaccaagtccttgagcagggcggtgtgtccagtttgtttcagaatctcggggtg
tccgtaactccgatccaaaggattgtcctgagcggtgaaaacggcctgaagatcgacatccatgtcatcatcccgtat
gaaggtctgagcggcgatcagatgggccagatcgaaaaaattttttaaggtggtgtaccctgtggatgat
```

SEQ ID NO: 195 (L27V CP 86 TEV)
MHHFKVILHYGTLVIDGVTPNMIDYFGRPYEGIAVFDGKKITVTGTLWNGNKIIDERLINPDGSLLFRVTINGVTGWR
LCERILAGSSGGGSSGGEPTTENLYFQSDNGSSGGGSSGGMVFTLEDFVGDWRQTAGYNLDQVLEQGGVSSLFQNLGV
SVTPIQRIVLSGENGLKIDIHVIIPYEGLSGDQMGQIEKIFKVVYPVDD

SEQ ID NO: 196 (L27V CP 87 TEV)
```
atgcactttaaggtgattctgcactatggcacactggtaatcgacggggttacgccgaacatgatcgactatttcgga
cggccgtatgaaggcatcgccgtgttcgacggcaaaaagatcactgtaaccgggaccctgtggaacggcaacaaaatt
atcgacgagcgcctgatcaaccccgacggctccctgctgttccgcgtaaccatcaacggagtgaccggctggcggctg
tgcgagcgcattttggcgggaagttctggtggaggaagttctggtggagagcctactactgagaacttgtacttccag
agcgataacggaagttctggtggaggaagttctggtggaatggtgtttacactcgaagatttcgtagggactggcggc
cagacagccggctacaacctggaccaagtccttgagcagggcggtgtgtccagtttgtttcagaatctcggggtgtcc
gtaactccgatccaaaggattgtcctgagcggtgaaaacggcctgaagatcgacatccatgtcatcatcccgtatgaa
ggtctgagcggcgatcagatgggccagatcgaaaaaattttttaaggtggtgtaccctgtggatgatcat
```

SEQ ID NO: 197 (L27V CP 87 TEV)
MHFKVILHYGTLVIDGVTPNMIDYFGRPYEGIAVFDGKKITVTGTLWNGNKIIDERLINPDGSLLFRVTINGVTGWRL
CERILAGSSGGGSSGGEPTTENLYFQSDNGSSGGGSSGGMVFTLEDFVGDWRQTAGYNLDQVLEQGGVSSLFQNLGVS
VTPIQRIVLSGENGLKIDIHVIIPYEGLSGDQMGQIEKIFKVVYPVDDH

SEQ ID NO: 198 (L27V CP 88 TEV)
```
atgtttaaggtgattctgcactatggcacactggtaatcgacggggttacgccgaacatgatcgactatttcggacgg
ccgtatgaaggcatcgccgtgttcgacggcaaaaagatcactgtaaccgggaccctgtggaacggcaacaaaattatc
gacgagcgcctgatcaaccccgacggctccctgctgttccgcgtaaccatcaacggagtgaccggctggcggctgtgc
gagcgcattttggcgggaagttctggtggaggaagttctggtggagagcctactactgagaacttgtacttccagagc
gataacggaagttctggtggaggaagttctggtggaatggtgtttacactcgaagatttcgtagggactggcggcag
acagccggctacaacctggaccaagtccttgagcagggcggtgtgtccagtttgtttcagaatctcggggtgtccgta
actccgatccaaaggattgtcctgagcggtgaaaacggcctgaagatcgacatccatgtcatcatcccgtatgaaggt
ctgagcggcgatcagatgggccagatcgaaaaaattttttaaggtggtgtaccctgtggatgatcatcac
```

SEQ ID NO: 199 (L27V CP 88 TEV)
MFKVILHYGTLVIDGVTPNMIDYFGRPYEGIAVFDGKKITVTGTLWNGNKIIDERLINPDGSLLFRVTINGVTGWRLC
ERILAGSSGGGSSGGEPTTENLYFQSDNGSSGGGSSGGMVFTLEDFVGDWRQTAGYNLDQVLEQGGVSSLFQNLGVSV
TPIQRIVLSGENGLKIDIHVIIPYEGLSGDQMGQIEKIFKVVYPVDDHH

SEQ ID NO: 200 (L27V CP 91 TEV)
```
atgattctgcactatggcacactggtaatcgacggggttacgccgaacatgatcgactatttcggacggccgtatgaa
ggcatcgccgtgttcgacggcaaaaagatcactgtaaccgggaccctgtggaacggcaacaaaattatcgacgagcgc
ctgatcaaccccgacggctccctgctgttccgcgtaaccatcaacggagtgaccggctggcggctgtgcgagcgcatt
ttggcgggaagttctggtggaggaagttctggtggagagcctactactgagaacttgtacttccagagcgataacgga
agttctggtggaggaagttctggtggaatggtgtttacactcgaagatttcgtagggactggcggcagacagccggc
tacaacctggaccaagtccttgagcagggcggtgtgtccagtttgtttcagaatctcggggtgtccgtaactccgatc
caaaggattgtcctgagcggtgaaaacggcctgaagatcgacatccatgtcatcatcccgtatgaaggtctgagcggc
gatcagatgggccagatcgaaaaaattttttaaggtggtgtaccctgtggatgatcatcactttaaggtg
```

SEQ ID NO: 201 (L27V CP 91 TEV)
MILHYGTLVIDGVTPNMIDYFGRPYEGIAVFDGKKITVTGTLWNGNKIIDERLINPDGSLLFRVTINGVTGWRLCERI
LAGSSGGGSSGGEPTTENLYFQSDNGSSGGGSSGGMVFTLEDFVGDWRQTAGYNLDQVLEQGGVSSLFQNLGVSVTPI
QRIVLSGENGLKIDIHVIIPYEGLSGDQMGQIEKIFKVVYPVDDHHFKV

SEQ ID NO: 202 (L27V CP 94 TEV)
```
atgtatggcacactggtaatcgacggggttacgccgaacatgatcgactatttcggacggccgtatgaaggcatcgcc
gtgttcgacggcaaaaagatcactgtaaccgggaccctgtggaacggcaacaaaattatcgacgagcgcctgatcaac
cccgacggctccctgctgttccgcgtaaccatcaacggagtgaccggctggcggctgtgcgagcgcattttggcggga
agttctggtggaggaagttctggtggagagcctactactgagaacttgtacttccagagcgataacggaagttctggt
ggaggaagttctggtggaatggtgtttacactcgaagatttcgtagggactggcggcagacagccggctacaacctg
gaccaagtccttgagcagggcggtgtgtccagtttgtttcagaatctcggggtgtccgtaactccgatccaaaggatt
gtcctgagcggtgaaaacggcctgaagatcgacatccatgtcatcatcccgtatgaaggtctgagcggcgatcagatg
ggccagatcgaaaaaattttttaaggtggtgtaccctgtggatgatcatcactttaaggtgattctgcacg
```

SEQUENCE LISTING

SEQ ID NO: 203 (L27V CP 94 TEV)
MYGTLVIDGVTPNMIDYFGRPYEGIAVFDGKKITVTGTLWNGNKIIDERLINPDGSLLFRVTINGVTGWRLCERILAG
SSGGGSSGGEPTTENLYFQSDNGSSGGGSSGGMVFTLEDFVGDWRQTAGYNLDQVLEQGGVSSLFQNLGVSVTPIQRI
VLSGENGLKIDIHVIIPYEGLSGDQMGQIEKIFKVVYPVDDHHFKVILH

SEQ ID NO: 204 (L27V CP 95 TEV)
atgggcacactggtaatcgacggggttacgccgaacatgatcgactatttcggacggccgtatgaaggcatcgccgtg
ttcgacggcaaaaagatcactgtaaccgggaccctgtggaacggcaacaaaattatcgacgagcgcctgatcaacccc
gacggctccctgctgttccgcgtaaccatcaacggagtgaccggctggcggctgtgcgagcgcattttggcgggaagt
tctggtggaggaagttctggtggagagcctactactgagaacttgtacttccagagcgataacggaagttctggtgga
ggaagttctggtggaatggtgtttacactcgaagatttcgtaggggactggcggcagacagccggctacaacctggac
caagtccttgagcagggcggtgtgtccagtttgtttcagaatctcggggtgtccgtaactccgatccaaaggattgtc
ctgagcggtgaaaacggcctgaagatcgacatccatgtcatcatcccgtatgaaggtctgagcggcgatcagatgggc
cagatcgaaaaaattttttaaggtggtgtaccctgtggatgatcatcacttttaaggtgattctgcactat SEQ ID NO: 205 (L27V CP 95 TEV)
MGTLVIDGVTPNMIDYFGRPYEGIAVFDGKKITVTGTLWNGNKIIDERLINPDGSLLFRVTINGVTGWRLCERILAGS
SGGGSSGGEPTTENLYFQSDNGSSGGGSSGGMVFTLEDFVGDWRQTAGYNLDQVLEQGGVSSLFQNLGVSVTPIQRIV
LSGENGLKIDIHVIIPYEGLSGDQMGQIEKIFKVVYPVDDHHFKVILHY SEQ ID NO: 206 (L27V CP 97 TEV)
atgctggtaatcgacggggttacgccgaacatgatcgactatttcggacggccgtatgaaggcatcgccgtgttcgac
ggcaaaaagatcactgtaaccgggaccctgtggaacggcaacaaaattatcgacgagcgcctgatcaaccccgacggc
tccctgctgttccgcgtaaccatcaacggagtgaccggctggcggctgtgcgagcgcattttggcgggaagttctggt
ggaggaagttctggtggagagcctactactgagaacttgtacttccagagcgataacggaagttctggtggaggaagt
tctggtggaatggtgtttacactcgaagatttcgtaggggactggcggcagacagccggctacaacctggaccaagtc
cttgagcagggcggtgtgtccagtttgtttcagaatctcggggtgtccgtaactccgatccaaaggattgtcctgagc
ggtgaaaacggcctgaagatcgacatccatgtcatcatcccgtatgaaggtctgagcggcgatcagatgggccagatc
gaaaaaattttttaaggtggtgtaccctgtggatgatcatcacttttaaggtgattctgcactatggcaca SEQ ID NO: 207 (L27V CP 97 TEV)
MLVIDGVTPNMIDYFGRPYEGIAVFDGKKITVTGTLWNGNKIIDERLINPDGSLLFRVTINGVTGWRLCERILAGSSG
GGSSGGEPTTENLYFQSDNGSSGGGSSGGMVFTLEDFVGDWRQTAGYNLDQVLEQGGVSSLFQNLGVSVTPIQRIVLS
GENGLKIDIHVIIPYEGLSGDQMGQIEKIFKVVYPVDDHHFKVILHYGT SEQ ID NO: 208 (L27V CP 100 TEV)
Atggacggggttacgccgaacatgatcgactatttcggacggccgtatgaaggcatcgccgtgttcgacggcaaaaag
atcactgtaaccgggaccctgtggaacggcaacaaaattatcgacgagcgcctgatcaaccccgacggctccctgctg
ttccgcgtaaccatcaacggagtgaccggctggcggctgtgcgagcgcattttggcgggaagttctggtggaggaagt
tctggtggagagcctactactgagaacttgtacttccagagcgataacggaagttctggtggaggaagttctggtgga
atggtgtttacactcgaagatttcgtaggggactggcggcagacagccggctacaacctggaccaagtccttgagcag
ggcggtgtgtccagtttgtttcagaatctcggggtgtccgtaactccgatccaaaggattgtcctgagcggtgaaaac
ggcctgaagatcgacatccatgtcatcatcccgtatgaaggtctgagcggcgatcagatgggccagatcgaaaaaatt
tttaaggtggtgtaccctgtggatgatcatcacttttaaggtgattctgcactatggcacactggtaatc SEQ ID NO: 209 (L27V CP 100 TEV)
MDGVTPNMIDYFGRPYEGIAVFDGKKITVTGTLWNGNKIIDERLINPDGSLLFRVTINGVTGWRLCERILAGSSGGGS
SGGEPTTENLYFQSDNGSSGGGSSGGMVFTLEDFVGDWRQTAGYNLDQVLEQGGVSSLFQNLGVSVTPIQRIVLSGEN
GLKIDIHVIIPYEGLSGDQMGQIEKIFKVVYPVDDHHFKVILHYGTLVI SEQ ID NO: 210 (L27V CP 101 TEV)
atgggggttacgccgaacatgatcgactatttcggacggccgtatgaaggcatcgccgtgttcgacggcaaaaagatc
actgtaaccgggaccctgtggaacggcaacaaaattatcgacgagcgcctgatcaaccccgacggctccctgctgttc
cgcgtaaccatcaacggagtgaccggctggcggctgtgcgagcgcattttggcgggaagttctggtggaggaagttct
ggtggagagcctactactgagaacttgtacttccagagcgataacggaagttctggtggaggaagttctggtggaatg
gtgtttacactcgaagatttcgtaggggactggcggcagacagccggctacaacctggaccaagtccttgagcagggc
ggtgtgtccagtttgtttcagaatctcggggtgtccgtaactccgatccaaaggattgtcctgagcggtgaaaacggc
ctgaagatcgacatccatgtcatcatcccgtatgaaggtctgagcggcgatcagatgggccagatcgaaaaaatttttt
aaggtggtgtaccctgtggatgatcatcactttaaggtgattctgcactatggcacactggtaatcgac SEQ ID NO: 211 (L27V CP 101 TEV)
MGVTPNMIDYFGRPYEGIAVFDGKKITVTGTLWNGNKIIDERLINPDGSLLFRVTINGVTGWRLCERILAGSSGGGSS
GGEPTTENLYFQSDNGSSGGGSSGGMVFTLEDFVGDWRQTAGYNLDQVLEQGGVSSLFQNLGVSVTPIQRIVLSGENG
LKIDIHVIIPYEGLSGDQMGQIEKIFKVVYPVDDHHFKVILHYGTLVID SEQ ID NO: 212 (L27V CP 102 TEV)
atggttacgccgaacatgatcgactatttcggacggccgtatgaaggcatcgccgtgttcgacggcaaaaagatcact
gtaaccgggaccctgtggaacggcaacaaaattatcgacgagcgcctgatcaaccccgacggctccctgctgttccgc
gtaaccatcaacggagtgaccggctggcggctgtgcgagcgcattttggcgggaagttctggtggaggaagttctggt
ggagagcctactactgagaacttgtacttccagagcgataacggaagttctggtggaggaagttctggtggaatggtg
tttacactcgaagatttcgtaggggactggcggcagacagccggctacaacctggaccaagtccttgagcagggcggt
gtgtccagtttgtttcagaatctcggggtgtccgtaactccgatccaaaggattgtcctgagcggtgaaaacggcctg

SEQUENCE LISTING

```
aagatcgacatccatgtcatcatcccgtatgaaggtctgagcggcgatcagatgggccagatcgaaaaaattttaag
gtggtgtaccctgtggatgatcatcactttaaggtgattctgcactatggcacactggtaatcgacggg
```

SEQ ID NO: 213 (L27V CP 102 TEV)
MVTPNMIDYFGRPYEGIAVFDGKKITVTGTLWNGNKIIDERLINPDGSLLFRVTINGVTGWRLCERILAGSSGGGSSG
GEPTTENLYFQSDNGSSGGGSSGGMVFTLEDFVGDWRQTAGYNLDQVLEQGGVSSLFQNLGVSVTPIQRIVLSGENGL
KIDIHVIIPYEGLSGDQMGQIEKIFKVVYPVDDHHFKVILHYGTLVIDG

SEQ ID NO: 214 (L27V CP 103 TEV)
```
atgacgccgaacatgatcgactatttcggacggccgtatgaaggcatcgccgtgttcgacggcaaaaagatcactgta
accgggaccctgtggaacggcaacaaaattatcgacgagcgcctgatcaaccccgacggctccctgctgttccgcgta
accatcaacggagtgaccggctggcggctgtgcgagcgcattttggcgggaagttctggtggaggaagttctggtgga
gagcctactactgagaacttgtacttccagagcgataacggaagttctggtggaggaagttctggtggaatggtgttt
acactcgaagatttcgtaggggactggcggcagacagccggctacaacctggaccaagtccttgagcagggcggtgtg
tccagtttgtttcagaatctcggggtgtccgtaactccgatccaaaggattgtcctgagcggtgaaaacggcctgaag
atcgacatccatgtcatcatcccgtatgaaggtctgagcggcgatcagatgggccagatcgaaaaaattttaaggtg
gtgtaccctgtggatgatcatcactttaaggtgattctgcactatggcacactggtaatcgacggggtt
```

SEQ ID NO: 215 (L27V CP 103 TEV)
MTPNMIDYFGRPYEGIAVFDGKKIITVTGTLWNGNKIIDERLINPDGSLLFRVTINGVTGWRLCERILAGSSGGGSSGG
EPTTENLYFQSDNGSSGGGSSGGMVFTLEDFVGDWRQTAGYNLDQVLEQGGVSSLFQNLGVSVTPIQRIVLSGENGLK
IDIHVIIPYEGLSGDQMGQIEKIFKVVYPVDDHHFKVILHYGTLVIDGV

SEQ ID NO: 216 (L27V CP 104 TEV)
```
atgccgaacatgatcgactatttcggacggccgtatgaaggcatcgccgtgttcgacggcaaaaagatcactgtaacc
gggaccctgtggaacggcaacaaaattatcgacgagcgcctgatcaaccccgacggctccctgctgttccgcgtaacc
atcaacggagtgaccggctggcggctgtgcgagcgcattttggcgggaagttctggtggaggaagttctggtggagag
cctactactgagaacttgtacttccagagcgataacggaagttctggtggaggaagttctggtggaatggtgttttaca
ctcgaagatttcgtaggggactggcggcagacagccggctacaacctggaccaagtccttgagcagggcggtgtgtcc
agtttgtttcagaatctcggggtgtccgtaactccgatccaaaggattgtcctgagcggtgaaaacggcctgaagatc
gacatccatgtcatcatcccgtatgaaggtctgagcggcgatcagatgggccagatcgaaaaaattttaaggtggtg
taccctgtggatgatcatcactttaaggtgattctgcactatggcacactggtaatcgacggggttacg
```

SEQ ID NO: 217 (L27V CP 104 TEV)
MPNMIDYFGRPYEGIAVFDGKKITVTGTLWNGNKIIDERLINPDGSLLFRVTINGVTGWRLCERILAGSSGGGSSGGE
PTTENLYFQSDNGSSGGGSSGGMVFTLEDFVGDWRQTAGYNLDQVLEQGGVSSLFQNLGVSVTPIQRIVLSGENGLKI
DIHVIIPYEGLSGDQMGQIEKIFKVVYPVDDHHFKVILHYGTLVIDGVT

SEQ ID NO: 218 (L27V CP 105 TEV)
```
atgaacatgatcgactatttcggacggccgtatgaaggcatcgccgtgttcgacggcaaaaagatcactgtaaccggg
accctgtggaacggcaacaaaattatcgacgagcgcctgatcaaccccgacggctccctgctgttccgcgtaaccatc
aacggagtgaccggctggcggctgtgcgagcgcattttggcgggaagttctggtggaggaagttctggtggagagcct
actactgagaacttgtacttccagagcgataacggaagttctggtggaggaagttctggtggaatggtgttttacactc
gaagatttcgtaggggactggcggcagacagccggctacaacctggaccaagtccttgagcagggcggtgtgtccagt
ttgtttcagaatctcggggtgtccgtaactccgatccaaaggattgtcctgagcggtgaaaacggcctgaagatcgac
atccatgtcatcatcccgtatgaaggtctgagcggcgatcagatgggccagatcgaaaaaattttaaggtggtgtac
cctgtggatgatcatcactttaaggtgattctgcactatggcacactggtaatcgacggggttacg
```

SEQ ID NO: 219 (L27V CP 105 TEV)
MNMIDYFGRPYEGIAVFDGKKITVTGTLWNGNKIIDERLINPDGSLLFRVTINGVTGWRLCERILAGSSGGGSSGGEP
TTENLYFQSDNGSSGGGSSGGMVFTLEDFVGDWRQTAGYNLDQVLEQGGVSSLFQNLGVSVTPIQRIVLSGENGLKID
IHVIIPYEGLSGDQMGQIEKIFKVVYPVDDHHFKVILHYGTLVIDGVT

SEQ ID NO: 220 (L27V CP 106 TEV)
```
atgatgatcgactatttcggacggccgtatgaaggcatcgccgtgttcgacggcaaaaagatcactgtaaccgggacc
ctgtggaacggcaacaaaattatcgacgagcgcctgatcaaccccgacggctccctgctgttccgcgtaaccatcaac
ggagtgaccggctggcggctgtgcgagcgcattttggcgggaagttctggtggaggaagttctggtggagagcctact
actgagaacttgtacttccagagcgataacggaagttctggtggaggaagttctggtggaatggtgttttacactcgaa
gatttcgtaggggactggcggcagacagccggctacaacctggaccaagtccttgagcagggcggtgtgtccagtttg
tttcagaatctcggggtgtccgtaactccgatccaaaggattgtcctgagcggtgaaaacggcctgaagatcgacatc
catgtcatcatcccgtatgaaggtctgagcggcgatcagatgggccagatcgaaaaaattttaaggtggtgtaccct
gtggatgatcatcactttaaggtgattctgcactatggcacactggtaatcgacggggttacgccgaac
```

SEQ ID NO: 221 (L27V CP 106 TEV)
MMIDYFGRPYEGIAVFDGKKITVTGTLWNGNKIIDERLINPDGSLLFRVTINGVTGWRLCERILAGSSGGGSSGGEPT
TENLYFQSDNGSSGGGSSGGMVFTLEDFVGDWRQTAGYNLDQVLEQGGVSSLFQNLGVSVTPIQRIVLSGENGLKIDI
HVIIPYEGLSGDQMGQIEKIFKVVYPVDDHHFKVILHYGTLVIDGVTPN

SEQ ID NO: 222 (L27V CP 109 TEV)
```
atgtatttcggacggccgtatgaaggcatcgccgtgttcgacggcaaaaagatcactgtaaccgggaccctgtggaac
ggcaacaaaattatcgacgagcgcctgatcaaccccgacggctccctgctgttccgcgtaaccatcaacggagtgacc
ggctggcggctgtgcgagcgcattttggcgggaagttctggtggaggaagttctggtggagagcctactactgagaac
ttgtacttccagagcgataacggaagttctggtggaggaagttctggtggaatggtgttttacactcgaagatttcgta
ggggactggcggcagacagccggctacaacctggaccaagtccttgagcagggcggtgtgtccagtttgtttcagaat
ctcggggtgtccgtaactccgatccaaaggattgtcctgagcggtgaaaacggcctgaagatcgacatccatgtcatc
atcccgtatgaaggtctgagcggcgatcagatgggccagatcgaaaaaattttaaggtggtgtaccctgtggatgat
catcactttaaggtgattctgcactatggcacactggtaatcgacggggttacgccgaacatgatcgac
```

SEQUENCE LISTING

SEQ ID NO: 223 (L27V CP 109 TEV)
MYFGRPYEGIAVFDGKKITVTGTLWNGNKIIDERLINPDGSLLFRVTINGVTGWRLCERILAGSSGGGSSGGEPTTEN
LYFQSDNGSSGGGSSGGMVFTLEDFVGDWRQTAGYNLDQVLEQGGVSSLFQNLGVSVTPIQRIVLSGENGLKIDIHVI
IPYEGLSGDQMGQIEKIFKVVYPVDDHHFKVILHYGTLVIDGVTPNMID

SEQ ID NO: 224 (L27V CP 112 TEV)
atgcggccgtatgaaggcatcgccgtgttcgacggcaaaaagatcactgtaaccgggaccctgtggaacggcaacaaa
attatcgacgagcgcctgatcaaccccgacggctccctgctgttccgcgtaaccatcaacggagtgaccggctggcgg
ctgtgcgagcgcattttggcgggaagttctggtggaggaagttctggtggagagcctactactgagaacttgtacttc
cagagcgataacggaagttctggtggaggaagttctggtggaatggtgtttacactcgaagatttcgtaggggactgg
cggcagacagccggctacaacctggaccaagtccttgagcagggcggtgtgtccagtttgtttcagaatctcggggtg
tccgtaactccgatccaaaggattgtcctgagcggtgaaaacggcctgaagatcgacatccatgtcatcatcccgtat
gaaggtctgagcggcgatcagatgggccagatcgaaaaaattttttaaggtggtgtaccctgtggatgatcatcacttt
aaggtgattctgcactatggcacactggtaatcgacggggttacgccgaacatgatcgactatttcgga SEQ ID NO: 225 (L27V CP 112 TEV)
MRPYEGIAVFDGKKITVTGTLWNGNKIIDERLINPDGSLLFRVTINGVTGWRLCERILAGSSGGGSSGGEPTTENLYF
QSDNGSSGGGSSGGMVFTLEDFVGDWRQTAGYNLDQVLEQGGVSSLFQNLGVSVTPIQRIVLSGENGLKIDIHVIIPY
EGLSGDQMGQIEKIFKVVYPVDDHHFKVILHYGTLVIDGVTPNMIDYFG SEQ ID NO: 226 (L27V CP 115 TEV)
atggaaggcatcgccgtgttcgacggcaaaaagatcactgtaaccgggaccctgtggaacggcaacaaaattatcgac
gagcgcctgatcaaccccgacggctccctgctgttccgcgtaaccatcaacggagtgaccggctggcggctgtgcgag
cgcattttggcgggaagttctggtggaggaagttctggtggagagcctactactgagaacttgtacttccagagcgat
aacggaagttctggtggaggaagttctggtggaatggtgtttacactcgaagatttcgtaggggactggcggcagaca
gccggctacaacctggaccaagtccttgagcagggcggtgtgtccagtttgtttcagaatctcggggtgtccgtaact
ccgatccaaaggattgtcctgagcggtgaaaacggcctgaagatcgacatccatgtcatcatcccgtatgaaggtctg
agcggcgatcagatgggccagatcgaaaaaattttttaaggtggtgtaccctgtggatgatcatcacttttaaggtgatt
ctgcactatggcacactggtaatcgacggggttacgccgaacatgatcgactatttcggacggccgtat SEQ ID NO: 227 (L27V CP 115 TEV)
MEGIAVFDGKKITVTGTLWNGNKIIDERLINPDGSLLFRVTINGVTGWRLCERILAGSSGGGSSGGEPTTENLYFQSD
NGSSGGGSSGGMVFTLEDFVGDWRQTAGYNLDQVLEQGGVSSLFQNLGVSVTPIQRIVLSGENGLKIDIHVIIPYEGL
SGDQMGQIEKIFKVVYPVDDHHFKVILHYGTLVIDGVTPNMIDYFGRPY SEQ ID NO: 228 (L27V CP 120 TEV)
atgttcgacggcaaaaagatcactgtaaccgggaccctgtggaacggcaacaaaattatcgacgagcgcctgatcaac
cccgacggctccctgctgttccgcgtaaccatcaacggagtgaccggctggcggctgtgcgagcgcattttggcggga
agttctggtggaggaagttctggtggagagcctactactgagaacttgtacttccagagcgataacggaagttctggt
ggaggaagttctggtggaatggtgtttacactcgaagatttcgtaggggactggcggcagacagccggctacaacctg
gaccaagtccttgagcagggcggtgtgtccagtttgtttcagaatctcggggtgtccgtaactccgatccaaaggatt
gtcctgagcggtgaaaacggcctgaagatcgacatccatgtcatcatcccgtatgaaggtctgagcggcgatcagatg
ggccagatcgaaaaaattttttaaggtggtgtaccctgtggatgatcatcacttttaaggtgattctgcactatggcaca
ctggtaatcgacggggttacgccgaacatgatcgactatttcggacggccgtatgaaggcatcgtggcc SEQ ID NO: 229 (L27V CP 120 TEV)
MFDGKKITVTGTLWNGNKIIDERLINPDGSLLFRVTINGVTGWRLCERILAGSSGGGSSGGEPTTENLYFQSDNGSSG
GGSSGGMVFTLEDFVGDWRQTAGYNLDQVLEQGGVSSLFQNLGVSVTPIQRIVLSGENGLKIDIHVIIPYEGLSGDQM
GQIEKIFKVVYPVDDHHFKVILHYGTLVIDGVTPNMIDYFGRPYEGIVA SEQ ID NO: 230 (L27V CP 121 TEV)
atggacggcaaaaagatcactgtaaccgggaccctgtggaacggcaacaaaattatcgacgagcgcctgatcaacccc
gacggctccctgctgttccgcgtaaccatcaacggagtgaccggctggcggctgtgcgagcgcattttggcgggaagt
tctggtggaggaagttctggtggagagcctactactgagaacttgtacttccagagcgataacggaagttctggtgga
ggaagttctggtggaatggtgtttacactcgaagatttcgtaggggactggcggcagacagccggctacaacctggac
caagtccttgagcagggcggtgtgtccagtttgtttcagaatctcggggtgtccgtaactccgatccaaaggattgtc
ctgagcggtgaaaacggcctgaagatcgacatccatgtcatcatcccgtatgaaggtctgagcggcgatcagatgggc
cagatcgaaaaaattttttaaggtggtgtaccctgtggatgatcatcacttttaaggtgattctgcactatggcacactg
gtaatcgacggggttacgccgaacatgatcgactatttcggacggccgtatgaaggcatcgccgtgttc SEQ ID NO: 231 (L27V CP 121 TEV)
MDGKKITVTGTLWNGNKIIDERLINPDGSLLFRVTINGVTGWRLCERILAGSSGGGSSGGEPTTENLYFQSDNGSSGG
GSSGGMVFTLEDFVGDWRQTAGYNLDQVLEQGGVSSLFQNLGVSVTPIQRIVLSGENGLKIDIHVIIPYEGLSGDQMG
QIEKIFKVVYPVDDHHFKVILHYGTLVIDGVTPNMIDYFGRPYEGIAVF SEQ ID NO: 232 (L27V CP 123 TEV)
atgaaaaagatcactgtaaccgggaccctgtggaacggcaacaaaattatcgacgagcgcctgatcaaccccgacggc
tccctgctgttccgcgtaaccatcaacggagtgaccggctggcggctgtgcgagcgcattttggcgggaagttctggt
ggaggaagttctggtggagagcctactactgagaacttgtacttccagagcgataacggaagttctggtggaggaagt
tctggtggaatggtgtttacactcgaagatttcgtaggggactggcggcagacagccggctacaacctggaccaagtc
cttgagcagggcggtgtgtccagtttgtttcagaatctcggggtgtccgtaactccgatccaaaggattgtcctgagc
ggtgaaaacggcctgaagatcgacatccatgtcatcatcccgtatgaaggtctgagcggcgatcagatgggccagatc
gaaaaaattttttaaggtggtgtaccctgtggatgatcatcacttttaaggtgattctgcactatggcacactggtaatc
gacggggttacgccgaacatgatcgactatttcggacggccgtatgaaggcatcgccgtgttcgacggc

SEQUENCE LISTING

SEQ ID NO: 233 (L27V CP 123 TEV)
MKKITVTGTLWNGNKIIDERLINPDGSLLFRVTINGVTGWRLCERILAGSSGGGSSGGEPTTENLYFQSDNGSSGGGS
SGGMVFTLEDFVGDWRQTAGYNLDQVLEQGGVSSLFQNLGVSVTPIQRIVLSGENGLKIDIHVIIPYEGLSGDQMGQI
EKIFKVVYPVDDHHFKVILHYGTLVIDGVTPNMIDYFGRPYEGIAVFDG

SEQ ID NO: 234 (L27V CP 124 TEV)
Atgaagatcactgtaaccgggaccctgtggaacggcaacaaaattatcgacgagcgcctgatcaaccccgacggctcc
ctgctgttccgcgtaaccatcaacggagtgaccggctggcggctgtgcgagcgcattttggcgggaagttctggtgga
ggaagttctggtggagagcctactactgagaacttgtacttccagagcgataacggaagttctggtggaggaagttct
ggtggaatggtgtttacactcgaagatttcgtaggggactggcggcagacagccggctacaacctggaccaagtcctt
gagcagggcggtgtgtccagtttgtttcagaatctcggggtgtccgtaactccgatccaaaggattgtcctgagcggt
gaaaacggcctgaagatcgacatccatgtcatcatcccgtatgaaggtctgagcggcgatcagatgggccagatcgaa
aaaatttttaaggtggtgtaccctgtggatgatcatcactttaaggtgattctgcactatggcacactggtaatcgac
ggggttacgccgaacatgatcgactatttcggacggccgtatgaaggcatcgccgtgttcgacggcaaa SEQ ID NO: 235 (L27V CP 124 TEV)
MKITVTGTLWNGNKIIDERLINPDGSLLFRVTINGVTGWRLCERILAGSSGGGSSGGEPTTENLYFQSDNGSSGGGSS
GGMVFTLEDFVGDWRQTAGYNLDQVLEQGGVSSLFQNLGVSVTPIQRIVLSGENGLKIDIHVIIPYEGLSGDQMGQIE
KIFKVVYPVDDHHFKVILHYGTLVIDGVTPNMIDYFGRPYEGIAVFDGK SEQ ID NO: 236 (L27V CP 125 TEV)
atgatcactgtaaccgggaccctgtggaacggcaacaaaattatcgacgagcgcctgatcaaccccgacggctccctg
ctgttccgcgtaaccatcaacggagtgaccggctggcggctgtgcgagcgcattttggcgggaagttctggtggagga
agttctggtggagagcctactactgagaacttgtacttccagagcgataacggaagttctggtggaggaagttctggt
ggaatggtgtttacactcgaagatttcgtaggggactggcggcagacagccggctacaacctggaccaagtccttgag
cagggcggtgtgtccagtttgtttcagaatctcggggtgtccgtaactccgatccaaaggattgtcctgagcggtgaa
aacggcctgaagatcgacatccatgtcatcatcccgtatgaaggtctgagcggcgatcagatgggccagatcgaaaaa
atttttaaggtggtgtaccctgtggatgatcatcactttaaggtgattctgcactatggcacactggtaatcgacggg
gttacgccgaacatgatcgactatttcggacggccgtatgaaggcatcgccgtgttcgacggcaaaaag SEQ ID NO: 237 (L27V CP 125 TEV)
MITVTGTLWNGNKIIDERLINPDGSLLFRVTINGVTGWRLCERILAGSSGGGSSGGEPTTENLYFQSDNGSSGGGSSG
GMVFTLEDFVGDWRQTAGYNLDQVLEQGGVSSLFQNLGVSVTPIQRIVLSGENGLKIDIHVIIPYEGLSGDQMGQIEK
IFKVVYPVDDHHFKVILHYGTLVIDGVTPNMIDYFGRPYEGIAVFDGKK SEQ ID NO: 238 (L27V CP 129 TEV)
atggggaccctgtggaacggcaacaaaattatcgacgagcgcctgatcaaccccgacggctccctgctgttccgcgta
accatcaacggagtgaccggctggcggctgtgcgagcgcattttggcgggaagttctggtggaggaagttctggtgga
gagcctactactgagaacttgtacttccagagcgataacggaagttctggtggaggaagttctggtggaatggtgttt
acactcgaagatttcgtaggggactggcggcagacagccggctacaacctggaccaagtccttgagcagggcggtgtg
tccagtttgtttcagaatctcggggtgtccgtaactccgatccaaaggattgtcctgagcggtgaaaacggcctgaag
atcgacatccatgtcatcatcccgtatgaaggtctgagcggcgatcagatgggccagatcgaaaaaatttttaaggtg
gtgtaccctgtggatgatcatcactttaaggtgattctgcactatggcacactggtaatcgacggggttacgccgaac
atgatcgactatttcggacggccgtatgaaggcatcgccgtgttcgacggcaaaaagatcactgtaacc SEQ ID NO: 239 (L27V CP 129 TEV)
MGTLWNGNKIIDERLINPDGSLLFRVTINGVTGWRLCERILAGSSGGGSSGGEPTTENLYFQSDNGSSGGGSSGGMVF
TLEDFVGDWRQTAGYNLDQVLEQGGVSSLFQNLGVSVTPIQRIVLSGENGLKIDIHVIIPYEGLSGDQMGQIEKIFKV
VYPVDDHHFKVILHYGTLVIDGVTPNMIDYFGRPYEGIAVFDGKKITVT SEQ ID NO: 240 (L27V CP 130 TEV)
atgaccctgtggaacggcaacaaaattatcgacgagcgcctgatcaaccccgacggctccctgctgttccgcgtaacc
atcaacggagtgaccggctggcggctgtgcgagcgcattttggcgggaagttctggtggaggaagttctggtggagag
cctactactgagaacttgtacttccagagcgataacggaagttctggtggaggaagttctggtggaatggtgtttaca
ctcgaagatttcgtaggggactggcggcagacagccggctacaacctggaccaagtccttgagcagggcggtgtgtcc
agtttgtttcagaatctcggggtgtccgtaactccgatccaaaggattgtcctgagcggtgaaaacggcctgaagatc
gacatccatgtcatcatcccgtatgaaggtctgagcggcgatcagatgggccagatcgaaaaaatttttaaggtggtg
taccctgtggatgatcatcactttaaggtgattctgcactatggcacactggtaatcgacggggttacgccgaacatg
atcgactatttcggacggccgtatgaaggcatcgccgtgttcgacggcaaaaagatcactgtaaccggg SEQ ID NO: 241 (L27V CP 130 TEV)
MTLWNGNKIIDERLINPDGSLLFRVTINGVTGWRLCERILAGSSGGGSSGGEPTTENLYFQSDNGSSGGGSSGGMVFT
LEDFVGDWRQTAGYNLDQVLEQGGVSSLFQNLGVSVTPIQRIVLSGENGLKIDIHVIIPYEGLSGDQMGQIEKIFKVV
YPVDDHHFKVILHYGTLVIDGVTPNMIDYFGRPYEGIAVFDGKKITVTG SEQ ID NO: 242 (L27V CP 131 TEV)
atgctgtggaacggcaacaaaattatcgacgagcgcctgatcaaccccgacggctccctgctgttccgcgtaaccatc
aacggagtgaccggctggcggctgtgcgagcgcattttggcgggaagttctggtggaggaagttctggtggagagcct
actactgagaacttgtacttccagagcgataacggaagttctggtggaggaagttctggtggaatggtgtttacactc
gaagatttcgtaggggactggcggcagacagccggctacaacctggaccaagtccttgagcagggcggtgtgtccagt
ttgtttcagaatctcggggtgtccgtaactccgatccaaaggattgtcctgagcggtgaaaacggcctgaagatcgac
atccatgtcatcatcccgtatgaaggtctgagcggcgatcagatgggccagatcgaaaaaatttttaaggtggtgtac

```
                        SEQUENCE LISTING
cctgtggatgatcatcactttaaggtgattctgcactatggcacactggtaatcgacggggttacgccgaacatgatc
gactatttcggacggccgtatgaaggcatcgccgtgttcgacggcaaaaagatcactgtaaccgggacc SEQ ID NO: 243 (L27V CP 131 TEV)
MLWNGNKIIDERLINPDGSLLFRVTINGVTGWRLCERILAGSSGGGSSGGEPTTENLYFQSDNGSSGGGSSGGMVFTL
EDFVGDWRQTAGYNLDQVLEQGGVSSLFQNLGVSVTPIQRIVLSGENGLKIDIHVIIPYEGLSGDQMGQIEKIFKVVY
PVDDHHFKVILHYGTLVIDGVTPNMIDYFGRPYEGIAVFDGKKITVTGT SEQ ID NO: 244 (L27V CP 133 TEV)
atgaacggcaacaaaattatcgacgagcgcctgatcaaccccgacggctccctgctgttccgcgtaaccatcaacgga
gtgaccggctggcggctgtgcgagcgcattttggcgggaagttctggtggaggaagttctggtggagagcctactact
gagaacttgtacttccagagcgataacggaagttctggtggaggaagttctggtggaatggtgtttacactcgaagat
ttcgtaggggactggcggcagacagccggctacaacctggaccaagtccttgagcagggcggtgtgtccagtttgttt
cagaatctcggggtgtccgtaactccgatccaaaggattgtcctgagcggtgaaaacggcctgaagatcgacatccat
gtcatcatcccgtatgaaggtctgagcggcgatcagatgggccagatcgaaaaaatttttaaggtggtgtaccctgtg
gatgatcatcactttaaggtgattctgcactatggcacactggtaatcgacggggttacgccgaacatgatcgactat
ttcggacggccgtatgaaggcatcgccgtgttcgacggcaaaaagatcactgtaaccgggaccctgtggg SEQ ID NO: 245 (L27V CP 133 TEV)
MNGNKIIDERLINPDGSLLFRVTINGVTGWRLCERILAGSSGGGSSGGEPTTENLYFQSDNGSSGGGSSGGMVFTLED
FVGDWRQTAGYNLDQVLEQGGVSSLFQNLGVSVTPIQRIVLSGENGLKIDIHVIIPYEGLSGDQMGQIEKIFKVVYPV
DDHHFKVILHYGTLVIDGVTPNMIDYFGRPYEGIAVFDGKKITVTGTLW SEQ ID NO: 246 (L27V CP 136 TEV)
atgaaaattatcgacgagcgcctgatcaaccccgacggctccctgctgttccgcgtaaccatcaacggagtgaccggc
tggcggctgtgcgagcgcattttggcgggaagttctggtggaggaagttctggtggagagcctactactgagaacttg
tacttccagagcgataacggaagttctggtggaggaagttctggtggaatggtgtttacactcgaagatttcgtaggg
gactggcggcagacagccggctacaacctggaccaagtccttgagcagggcggtgtgtccagtttgtttcagaatctc
ggggtgtccgtaactccgatccaaaggattgtcctgagcggtgaaaacggcctgaagatcgacatccatgtcatcatc
ccgtatgaaggtctgagcggcgatcagatgggccagatcgaaaaaatttttaaggtggtgtaccctgtggatgatcat
cactttaaggtgattctgcactatggcacactggtaatcgacggggttacgccgaacatgatcgactatttcggacgg
ccgtatgaaggcatcgccgtgttcgacggcaaaaagatcactgtaaccgggaccctgtggaacggcaac SEQ ID NO: 247 (L27V CP 136 TEV)
MKIIDERLINPDGSLLFRVTINGVTGWRLCERILAGSSGGGSSGGEPTTENLYFQSDNGSSGGGSSGGMVFTLEDFVG
DWRQTAGYNLDQVLEQGGVSSLFQNLGVSVTPIQRIVLSGENGLKIDIHVIIPYEGLSGDQMGQIEKIFKVVYPVDDH
HFKVILHYGTLVIDGVTPNMIDYFGRPYEGIAVFDGKKITVTGTLWNGN SEQ ID NO: 248 (L27V CP 139 TEV)
atggacgagcgcctgatcaaccccgacggctccctgctgttccgcgtaaccatcaacggagtgaccggctggcggctg
tgcgagcgcattttggcgggaagttctggtggaggaagttctggtggagagcctactactgagaacttgtacttccag
agcgataacggaagttctggtggaggaagttctggtggaatggtgtttacactcgaagatttcgtaggggactggcgg
cagacagccggctacaacctggaccaagtccttgagcagggcggtgtgtccagtttgtttcagaatctcggggtgtcc
gtaactccgatccaaaggattgtcctgagcggtgaaaacggcctgaagatcgacatccatgtcatcatcccgtatgaa
ggtctgagcggcgatcagatgggccagatcgaaaaaatttttaaggtggtgtaccctgtggatgatcatcactttaag
gtgattctgcactatggcacactggtaatcgacggggttacgccgaacatgatcgactatttcggacggccgtatgaa
ggcatcgccgtgttcgacggcaaaaagatcactgtaaccgggaccctgtggaacggcaacaaaattatcgacgagcgc SEQ ID NO: 249 (L27V CP 139 TEV)
MDERLINPDGSLLFRVTINGVTGWRLCERILAGSSGGGSSGGEPTTENLYFQSDNGSSGGGSSGGMVFTLEDFVGDWR
QTAGYNLDQVLEQGGVSSLFQNLGVSVTPIQRIVLSGENGLKIDIHVIIPYEGLSGDQMGQIEKIFKVVYPVDDHHFK
VILHYGTLVIDGVTPNMIDYFGRPYEGIAVFDGKKITVTGTLWNGNKIIDER SEQ ID NO: 250 (L27V CP 140 TEV)
atggagcgcctgatcaaccccgacggctccctgctgttccgcgtaaccatcaacggagtgaccggctggcggctgtgc
gagcgcattttggcgggaagttctggtggaggaagttctggtggagagcctactactgagaacttgtacttccagagc
gataacggaagttctggtggaggaagttctggtggaatggtgtttacactcgaagatttcgtaggggactggcggcag
acagccggctacaacctggaccaagtccttgagcagggcggtgtgtccagtttgtttcagaatctcggggtgtccgta
actccgatccaaaggattgtcctgagcggtgaaaacggcctgaagatcgacatccatgtcatcatcccgtatgaaggt
ctgagcggcgatcagatgggccagatcgaaaaaatttttaaggtggtgtaccctgtggatgatcatcactttaaggtg
attctgcactatggcacactggtaatcgacggggttacgccgaacatgatcgactatttcggacggccgtatgaaggc
atcgccgtgttcgacggcaaaaagatcactgtaaccgggaccctgtggaacggcaacaaaattatcgac SEQ ID NO: 251 (L27V CP 140 TEV)
MERLINPDGSLLFRVTINGVTGWRLCERILAGSSGGGSSGGEPTTENLYFQSDNGSSGGGSSGGMVFTLEDFVGDWRQ
TAGYNLDQVLEQGGVSSLFQNLGVSVTPIQRIVLSGENGLKIDIHVIIPYEGLSGDQMGQIEKIFKVVYPVDDHHFKV
ILHYGTLVIDGVTPNMIDYFGRPYEGIAVFDGKKITVTGTLWNGNKIID SEQ ID NO: 252 (L27V CP 141 TEV)
atgcgcctgatcaaccccgacggctccctgctgttccgcgtaaccatcaacggagtgaccggctggcggctgtgcgag
cgcattttggcgggaagttctggtggaggaagttctggtggagagcctactactgagaacttgtacttccagagcgat
aacggaagttctggtggaggaagttctggtggaatggtgtttacactcgaagatttcgtaggggactggcggcagaca
gccggctacaacctggaccaagtccttgagcagggcggtgtgtccagtttgtttcagaatctcggggtgtccgtaact
ccgatccaaaggattgtcctgagcggtgaaaacggcctgaagatcgacatccatgtcatcatcccgtatgaaggtctg
agcggcgatcagatgggccagatcgaaaaaatttttaaggtggtgtaccctgtggatgatcatcactttaaggtgatt
ctgcactatggcacactggtaatcgacggggttacgccgaacatgatcgactatttcggacggccgtatgaaggcatc
gccgtgttcgacggcaaaaagatcactgtaaccgggaccctgtggaacggcaacaaaattatcgacgag
```

SEQUENCE LISTING

SEQ ID NO: 253 (L27V CP 141 TEV)
MRLINPDGSLLFRVTINGVTGWRLCERILAGSSGGGSSGGEPTTENLYFQSDNGSSGGGSSGGMVFTLEDFVGDWRQT
AGYNLDQVLEQGGVSSLFQNLGVSVTPIQRIVLSGENGLKIDIHVIIPYEGLSGDQMGQIEKIFKVVYPVDDHHFKVI
LHYGTLVIDGVTPNMIDYFGRPYEGIAVFDGKKITVTGTLWNGNKIIDE

SEQ ID NO: 254 (L27V CP 142 TEV)
atgctgatcaaccccgacggctccctgctgttccgcgtaaccatcaacggagtgaccggctggcggctgtgcgagcgc
attttggcgggaagttctggtggaggaagttctggtggagagcctactactgagaacttgtacttccagagcgataac
ggaagttctggtggaggaagttctggtggaatggtgtttacactcgaagatttcgtagggactggcggcagacagcc
ggctacaacctggaccaagtccttgagcagggcggtgtgtccagtttgtttcagaatctcggggtgtccgtaactccg
atccaaaggattgtcctgagcggtgaaaacggcctgaagatcgacatccatgtcatcatcccgtatgaaggtctgagc
ggcgatcagatgggccagatcgaaaaaattttttaaggtggtgtaccctgtggatgatcatcactttaaggtgattctg
cactatggcacactggtaatcgacggggttacgccgaacatgatcgactatttcggacggccgtatgaaggcatcgcc
gtgttcgacggcaaaaagatcactgtaaccgggaccctgtggaacggcaacaaaattatcgacgagcgc SEQ ID NO: 255 (L27V CP 142 TEV)
MLINPDGSLLFRVTINGVTGWRLCERILAGSSGGGSSGGEPTTENLYFQSDNGSSGGGSSGGMVFTLEDFVGDWRQTA
GYNLDQVLEQGGVSSLFQNLGVSVTPIQRIVLSGENGLKIDIHVIIPYEGLSGDQMGQIEKIFKVVYPVDDHHFKVIL
HYGTLVIDGVTPNMIDYFGRPYEGIAVFDGKKITVTGTLWNGNKIIDER SEQ ID NO: 256 (L27V CP 143 TEV)
atgatcaaccccgacggctccctgctgttccgcgtaaccatcaacggagtgaccggctggcggctgtgcgagcgcatt
ttggcgggaagttctggtggaggaagttctggtggagagcctactactgagaacttgtacttccagagcgataacgga
agttctggtggaggaagttctggtggaatggtgtttacactcgaagatttcgtagggactggcggcagacagccggc
tacaacctggaccaagtccttgagcagggcggtgtgtccagtttgtttcagaatctcggggtgtccgtaactccgatc
caaaggattgtcctgagcggtgaaaacggcctgaagatcgacatccatgtcatcatcccgtatgaaggtctgagcggc
gatcagatgggccagatcgaaaaaattttttaaggtggtgtaccctgtggatgatcatcactttaaggtgattctgcac
tatggcacactggtaatcgacggggttacgccgaacatgatcgactatttcggacggccgtatgaaggcatcgccgtg
ttcgacggcaaaaagatcactgtaaccgggaccctgtggaacggcaacaaaattatcgacgagcgcctg SEQ ID NO: 257 (L27V CP 143 TEV)
MINPDGSLLFRVTINGVTGWRLCERILAGSSGGGSSGGEPTTENLYFQSDNGSSGGGSSGGMVFTLEDFVGDWRQTAG
YNLDQVLEQGGVSSLFQNLGVSVTPIQRIVLSGENGLKIDIHVIIPYEGLSGDQMGQIEKIFKVVYPVDDHHFKVILH
YGTLVIDGVTPNMIDYFGRPYEGIAVFDGKKITVTGTLWNGNKIIDERL SEQ ID NO: 258 (L27V CP 144 TEV)
atgaaccccgacggctccctgctgttccgcgtaaccatcaacggagtgaccggctggcggctgtgcgagcgcattttg
gcgggaagttctggtggaggaagttctggtggagagcctactactgagaacttgtacttccagagcgataacggaagt
tctggtggaggaagttctggtggaatggtgtttacactcgaagatttcgtagggactggcggcagacagccggctac
aacctggaccaagtccttgagcagggcggtgtgtccagtttgtttcagaatctcggggtgtccgtaactccgatccaa
aggattgtcctgagcggtgaaaacggcctgaagatcgacatccatgtcatcatcccgtatgaaggtctgagcggcgat
cagatgggccagatcgaaaaaattttttaaggtggtgtaccctgtggatgatcatcactttaaggtgattctgcactat
ggcacactggtaatcgacggggttacgccgaacatgatcgactatttcggacggccgtatgaaggcatcgccgtgttc
gacggcaaaaagatcactgtaaccgggaccctgtggaacggcaacaaaattatcgacgagcgcctgatc SEQ ID NO: 259 (L27V CP 144 TEV)
MNPDGSLLFRVTINGVTGWRLCERILAGSSGGGSSGGEPTTENLYFQSDNGSSGGGSSGGMVFTLEDFVGDWRQTAGY
NLDQVLEQGGVSSLFQNLGVSVTPIQRIVLSGENGLKIDIHVIIPYEGLSGDQMGQIEKIFKVVYPVDDHHFKVILHY
GTLVIDGVTPNMIDYFGRPYEGIAVFDGKKITVTGTLWNGNKIIDERLI SEQ ID NO: 260 (L27V CP 145 TEV)
atgcccgacggctccctgctgttccgcgtaaccatcaacggagtgaccggctggcggctgtgcgagcgcattttggcg
ggaagttctggtggaggaagttctggtggagagcctactactgagaacttgtacttccagagcgataacggaagttct
ggtggaggaagttctggtggaatggtgtttacactcgaagatttcgtagggactggcggcagacagccggctacaac
ctggaccaagtccttgagcagggcggtgtgtccagtttgtttcagaatctcggggtgtccgtaactccgatccaaagg
attgtcctgagcggtgaaaacggcctgaagatcgacatccatgtcatcatcccgtatgaaggtctgagcggcgatcag
atgggccagatcgaaaaaattttttaaggtggtgtaccctgtggatgatcatcactttaaggtgattctgcactatggc
acactggtaatcgacggggttacgccgaacatgatcgactatttcggacggccgtatgaaggcatcgccgtgttcgac
ggcaaaaagatcactgtaaccgggaccctgtggaacggcaacaaaattatcgacgagcgcctgatcaac SEQ ID NO: 261 (L27V CP 145 TEV)
MPDGSLLFRVTINGVTGWRLCERILAGSSGGGSSGGEPTTENLYFQSDNGSSGGGSSGGMVFTLEDFVGDWRQTAGYN
LDQVLEQGGVSSLFQNLGVSVTPIQRIVLSGENGLKIDIHVIIPYEGLSGDQMGQIEKIFKVVYPVDDHHFKVILHYG
TLVIDGVTPNMIDYFGRPYEGIAVFDGKKITVTGTLWNGNKIIDERLIN SEQ ID NO: 262 (L27V CP 146 TEV)
atggacggctccctgctgttccgcgtaaccatcaacggagtgaccggctggcggctgtgcgagcgcattttggcggga
agttctggtggaggaagttctggtggagagcctactactgagaacttgtacttccagagcgataacggaagttctggt
ggaggaagttctggtggaatggtgtttacactcgaagatttcgtagggactggcggcagacagccggctacaacctg
gaccaagtccttgagcagggcggtgtgtccagtttgtttcagaatctcggggtgtccgtaactccgatccaaaggatt
gtcctgagcggtgaaaacggcctgaagatcgacatccatgtcatcatcccgtatgaaggtctgagcggcgatcagatg
ggccagatcgaaaaaattttttaaggtggtgtaccctgtggatgatcatcactttaaggtgattctgcactatggcaca
ctggtaatcgacggggttacgccgaacatgatcgactatttcggacggccgtatgaaggcatcgccgtgttcgacgc
aaaaagatcactgtaaccgggaccctgtggaacggcaacaaaattatcgacgagcgcctgatcaacccc

SEQUENCE LISTING

SEQ ID NO: 263 (L27V CP 146 TEV)
MDGSLLFRVTINGVTGWRLCERILAGSSGGGSSGGEPTTENLYFQSDNGSSGGGSSGGMVFTLEDFVGDWRQTAGYNL
DQVLEQGGVSSLFQNLGVSVTPIQRIVLSGENGLKIDIHVIIPYEGLSGDQMGQIEKIFKVVYPVDDHHFKVILHYGT
LVIDGVTPNMIDYFGRPYEGIAVFDGKKITVTGTLWNGNKIIDERLINP

SEQ ID NO: 264 (L27V CP 147 TEV)
atgggctccctgctgttccgcgtaaccatcaacggagtgaccggctggcggctgtgcgagcgcattttggcgggaagt
tctggtggaggaagttctggtggagagcctactactgagaacttgtacttccagagcgataacggaagttctggtgga
ggaagttctggtggaatggtgtttacactcgaagatttcgtagggggactggcggcagacagccggctacaacctggac
caagtccttgagcagggcggtgtgtccagtttgtttcagaatctcggggtgtccgtaactccgatccaaaggattgtc
ctgagcggtgaaaacggcctgaagatcgacatccatgtcatcatcccgtatgaaggtctgagcggcgatcagatgggc
cagatcgaaaaaattttttaaggtggtgtaccctgtggatgatcatcacttttaaggtgattctgcactatggcacactg
gtaatcgacggggttacgccgaacatgatcgactatttcggacggccgtatgaaggcatcgccgtgttcgacggcaaa
aagatcactgtaaccgggaccctgtggaacggcaacaaaattatcgacgagcgcctgatcaaccccgac SEQ ID NO: 265 (L27V CP 147 TEV)
MGSLLFRVTINGVTGWRLCERILAGSSGGGSSGGEPTTENLYFQSDNGSSGGGSSGGMVFTLEDFVGDWRQTAGYNLD
QVLEQGGVSSLFQNLGVSVTPIQRIVLSGENGLKIDIHVIIPYEGLSGDQMGQIEKIFKVVYPVDDHHFKVILHYGTL
VIDGVTPNMIDYFGRPYEGIAVFDGKKITVTGTLWNGNKIIDERLINPD SEQ ID NO: 266 (L27V CP 148 TEV)
atgtccctgctgttccgcgtaaccatcaacggagtgaccggctggcggctgtgcgagcgcattttggcgggaagttct
ggtggaggaagttctggtggagagcctactactgagaacttgtacttccagagcgataacggaagttctggtggagga
agttctggtggaatggtgtttacactcgaagatttcgtaggggactggcggcagacagccggctacaacctggaccaa
gtccttgagcagggcggtgtgtccagtttgtttcagaatctcggggtgtccgtaactccgatccaaaggattgtcctg
agcggtgaaaacggcctgaagatcgacatccatgtcatcatcccgtatgaaggtctgagcggcgatcagatgggccag
atcgaaaaaattttttaaggtggtgtaccctgtggatgatcatcacttttaaggtgattctgcactatggcacactggta
atcgacggggttacgccgaacatgatcgactatttcggacggccgtatgaaggcatcgccgtgttcgacggcaaaaag
atcactgtaaccgggaccctgtggaacggcaacaaaattatcgacgagcgcctgatcaaccccgacggc SEQ ID NO: 267 (L27V CP 148 TEV)
MSLLFRVTINGVTGWRLCERILAGSSGGGSSGGEPTTENLYFQSDNGSSGGGSSGGMVFTLEDFVGDWRQTAGYNLDQ
VLEQGGVSSLFQNLGVSVTPIQRIVLSGENGLKIDIHVIIPYEGLSGDQMGQIEKIFKVVYPVDDHHFKVILHYGTLV
IDGVTPNMIDYFGRPYEGIAVFDGKKITVTGTLWNGNKIIDERLINPDG SEQ ID NO: 268 (L27V CP 149 TEV)
atgctgctgttccgcgtaaccatcaacggagtgaccggctggcggctgtgcgagcgcattttggcgggaagttctggt
ggaggaagttctggtggagagcctactactgagaacttgtacttccagagcgataacggaagttctggtggaggaagt
tctggtggaatggtgtttacactcgaagatttcgtaggggactggcggcagacagccggctacaacctggaccaagtc
cttgagcagggcggtgtgtccagtttgtttcagaatctcggggtgtccgtaactccgatccaaaggattgtcctgagc
ggtgaaaacggcctgaagatcgacatccatgtcatcatcccgtatgaaggtctgagcggcgatcagatgggccagatc
gaaaaaattttttaaggtggtgtaccctgtggatgatcatcacttttaaggtgattctgcactatggcacactggtaatc
gacggggttacgccgaacatgatcgactatttcggacggccgtatgaaggcatcgccgtgttcgacggcaaaaagatc
actgtaaccgggaccctgtggaacggcaacaaaattatcgacgagcgcctgatcaaccccgacggctcc SEQ ID NO: 269 (L27V CP 149 TEV)
MLLFRVTINGVTGWRLCERILAGSSGGGSSGGEPTTENLYFQSDNGSSGGGSSGGMVFTLEDFVGDWRQTAGYNLDQV
LEQGGVSSLFQNLGVSVTPIQRIVLSGENGLKIDIHVIIPYEGLSGDQMGQIEKIFKVVYPVDDHHFKVILHYGTLVI
DGVTPNMIDYFGRPYEGIAVFDGKKITVTGTLWNGNKIIDERLINPDGS SEQ ID NO: 270 (L27V CP 150 TEV)
atgctgttccgcgtaaccatcaacggagtgaccggctggcggctgtgcgagcgcattttggcgggaagttctggtgga
ggaagttctggtggagagcctactactgagaacttgtacttccagagcgataacggaagttctggtggaggaagttct
ggtggaatggtgtttacactcgaagatttcgtaggggactggcggcagacagccggctacaacctggaccaagtcctt
gagcagggcggtgtgtccagtttgtttcagaatctcggggtgtccgtaactccgatccaaaggattgtcctgagcggt
gaaaacggcctgaagatcgacatccatgtcatcatcccgtatgaaggtctgagcggcgatcagatgggccagatcgaa
aaaattttttaaggtggtgtaccctgtggatgatcatcacttttaaggtgattctgcactatggcacactggtaatcgac
ggggttacgccgaacatgatcgactatttcggacggccgtatgaaggcatcgccgtgttcgacggcaaaaagatcact
gtaaccgggaccctgtggaacggcaacaaaattatcgacgagcgcctgatcaaccccgacggctccctg SEQ ID NO: 271 (L27V CP 150 TEV)
MLFRVTINGVTGWRLCERILAGSSGGGSSGGEPTTENLYFQSDNGSSGGGSSGGMVFTLEDFVGDWRQTAGYNLDQVL
EQGGVSSLFQNLGVSVTPIQRIVLSGENGLKIDIHVIIPYEGLSGDQMGQIEKIFKVVYPVDDHHFKVILHYGTLVID
GVTPNMIDYFGRPYEGIAVFDGKKITVTGTLWNGNKIIDERLINPDGSL SEQ ID NO: 272 (L27V CP 151 TEV)
atgttccgcgtaaccatcaacggagtgaccggctggcggctgtgcgagcgcattttggcgggaagttctggtggagga
agttctggtggagagcctactactgagaacttgtacttccagagcgataacggaagttctggtggaggaagttctggt
ggaatggtgtttacactcgaagatttcgtaggggactggcggcagacagccggctacaacctggaccaagtccttgag
cagggcggtgtgtccagtttgtttcagaatctcggggtgtccgtaactccgatccaaaggattgtcctgagcggtgaa
aacggcctgaagatcgacatccatgtcatcatcccgtatgaaggtctgagcggcgatcagatgggccagatcgaaaaa
attttttaaggtggtgtaccctgtggatgatcatcacttttaaggtgattctgcactatggcacactggtaatcgacggg -continued

SEQUENCE LISTING gttacgccgaacatgatcgactatttcggacggccgtatgaaggcatcgccgtgttcgacggcaaaaagatcactgta
accgggaccctgtggaacggcaacaaaattatcgacgagcgcctgatcaaccccgacggctccctgctg SEQ ID NO: 273 (L27V CP 151 TEV)
MFRVTINGVTGWRLCERILAGSSGGGSSGGEPTTENLYFQSDNGSSGGGSSGGMVFTLEDFVGDWRQTAGYNLDQVLE
QGGVSSLFQNLGVSVTPIQRIVLSGENGLKIDIHVIIPYEGLSGDQMGQIEKIFKVVYPVDDHHFKVILHYGTLVIDG
VTPNMIDYFGRPYEGIAVFDGKKITVTGTLWNGNKIIDERLINPDGSLL SEQ ID NO: 274 (L27V CP 154 TEV)
atgaccatcaacggagtgaccggctggcggctgtgcgagcgcattttggcgggaagttctggtggaggaagttctggt
ggagagcctactactgagaacttgtacttccagagcgataacggaagttctggtggaggaagttctggtggaatggtg
tttacactcgaagatttcgtaggggactggcggcagacagccggctacaacctggaccaagtccttgagcagggcggt
gtgtccagtttgtttcagaatctcggggtgtccgtaactccgatccaaaggattgtcctgagcggtgaaaacggcctg
aagatcgacatccatgtcatcatcccgtatgaaggtctgagcggcgatcagatgggccagatcgaaaaaatttttaag
gtggtgtaccctgtggatgatcatcactttaaggtgattctgcactatggcacactggtaatcgacggggttacgccg
aacatgatcgactatttcggacggccgtatgaaggcatcgccgtgttcgacggcaaaaagatcactgtaaccgggacc
ctgtggaacggcaacaaaattatcgacgagcgcctgatcaaccccgacggctccctgctgttccgcgta SEQ ID NO: 275 (L27V CP 154 TEV)
MTINGVTGWRLCERILAGSSGGGSSGGEPTTENLYFQSDNGSSGGGSSGGMVFTLEDFVGDWRQTAGYNLDQVLEQGG
VSSLFQNLGVSVTPIQRIVLSGENGLKIDIHVIIPYEGLSGDQMGQIEKIFKVVYPVDDHHFKVILHYGTLVIDGVTP
NMIDYFGRPYEGIAVFDGKKITVTGTLWNGNKIIDERLINPDGSLLFRV SEQ ID NO: 276 (L27V CP 156 TEV)
atgaacggagtgaccggctggcggctgtgcgagcgcattttggcgggaagttctggtggaggaagttctggtggagag
cctactactgagaacttgtacttccagagcgataacggaagttctggtggaggaagttctggtggaatggtgtttaca
ctcgaagatttcgtaggggactggcggcagacagccggctacaacctggaccaagtccttgagcagggcggtgtgtcc
agtttgtttcagaatctcggggtgtccgtaactccgatccaaaggattgtcctgagcggtgaaaacggcctgaagatc
gacatccatgtcatcatcccgtatgaaggtctgagcggcgatcagatgggccagatcgaaaaaatttttaaggtggtg
taccctgtggatgatcatcactttaaggtgattctgcactatggcacactggtaatcgacggggttacgccgaacatg
atcgactatttcggacggccgtatgaaggcatcgccgtgttcgacggcaaaaagatcactgtaaccgggaccctgtgg
aacggcaacaaaattatcgacgagcgcctgatcaaccccgacggctccctgctgttccgcgtaaccatc SEQ ID NO: 277 (L27V CP 156 TEV)
MNGVTGWRLCERILAGSSGGGSSGGEPTTENLYFQSDNGSSGGGSSGGMVFTLEDFVGDWRQTAGYNLDQVLEQGGVS
SLFQNLGVSVTPIQRIVLSGENGLKIDIHVIIPYEGLSGDQMGQIEKIFKVVYPVDDHHFKVILHYGTLVIDGVTPNM
IDYFGRPYEGIAVFDGKKITVTGTLWNGNKIIDERLINPDGSLLFRVTI SEQ ID NO: 278 (L27V CP 157 TEV)
atgggagtgaccggctggcggctgtgcgagcgcattttggcgggaagttctggtggaggaagttctggtggagagcct
actactgagaacttgtacttccagagcgataacggaagttctggtggaggaagttctggtggaatggtgtttacactc
gaagatttcgtaggggactggcggcagacagccggctacaacctggaccaagtccttgagcagggcggtgtgtccagt
ttgtttcagaatctcggggtgtccgtaactccgatccaaaggattgtcctgagcggtgaaaacggcctgaagatcgac
atccatgtcatcatcccgtatgaaggtctgagcggcgatcagatgggccagatcgaaaaaatttttaaggtggtgtac
cctgtggatgatcatcactttaaggtgattctgcactatggcacactggtaatcgacggggttacgccgaacatgatc
gactatttcggacggccgtatgaaggcatcgccgtgttcgacggcaaaaagatcactgtaaccgggaccctgtggaac
ggcaacaaaattatcgacgagcgcctgatcaaccccgacggctccctgctgttccgcgtaaccatcaac SEQ ID NO: 279 (L27V CP 157 TEV)
MGVTGWRLCERILAGSSGGGSSGGEPTTENLYFQSDNGSSGGGSSGGMVFTLEDFVGDWRQTAGYNLDQVLEQGGVSS
LFQNLGVSVTPIQRIVLSGENGLKIDIHVIIPYEGLSGDQMGQIEKIFKVVYPVDDHHFKVILHYGTLVIDGVTPNMI
DYFGRPYEGIAVFDGKKITVTGTLWNGNKIIDERLINPDGSLLFRVTIN SEQ ID NO: 280 (L27V CP 158 TEV)
atggtgaccggctggcggctgtgcgagcgcattttggcgggaagttctggtggaggaagttctggtggagagcctact
actgagaacttgtacttccagagcgataacggaagttctggtggaggaagttctggtggaatggtgtttacactcgaa
gatttcgtaggggactggcggcagacagccggctacaacctggaccaagtccttgagcagggcggtgtgtccagtttg
tttcagaatctcggggtgtccgtaactccgatccaaaggattgtcctgagcggtgaaaacggcctgaagatcgacatc
catgtcatcatcccgtatgaaggtctgagcggcgatcagatgggccagatcgaaaaaatttttaaggtggtgtaccct
gtggatgatcatcactttaaggtgattctgcactatggcacactggtaatcgacggggttacgccgaacatgatcgac
tatttcggacggccgtatgaaggcatcgccgtgttcgacggcaaaaagatcactgtaaccgggaccctgtggaacggc
aacaaaattatcgacgagcgcctgatcaaccccgacggctccctgctgttccgcgtaaccatcaacgga SEQ ID NO: 281 (L27V CP 158 TEV)
MVTGWRLCERILAGSSGGGSSGGEPTTENLYFQSDNGSSGGGSSGGMVFTLEDFVGDWRQTAGYNLDQVLEQGGVSSL
FQNLGVSVTPIQRIVLSGENGLKIDIHVIIPYEGLSGDQMGQIEKIFKVVYPVDDHHFKVILHYGTLVIDGVTPNMID
YFGRPYEGIAVFDGKKITVTGTLWNGNKIIDERLINPDGSLLFRVTING SEQ ID NO: 282 (L27V CP 160 TEV)
atgggctggcggctgtgcgagcgcattttggcgggaagttctggtggaggaagttctggtggagagcctactactgag
aacttgtacttccagagcgataacggaagttctggtggaggaagttctggtggaatggtgtttacactcgaagatttc
gtaggggactggcggcagacagccggctacaacctggaccaagtccttgagcagggcggtgtgtccagtttgtttcag
aatctcggggtgtccgtaactccgatccaaaggattgtcctgagcggtgaaaacggcctgaagatcgacatccatgtc
atcatcccgtatgaaggtctgagcggcgatcagatgggccagatcgaaaaaatttttaaggtggtgtaccctgtggat
gatcatcactttaaggtgattctgcactatggcacactggtaatcgacggggttacgccgaacatgatcgactatttc
ggacggccgtatgaaggcatcgccgtgttcgacggcaaaaagatcactgtaaccgggaccctgtggaacggcaacaaa
attatcgacgagcgcctgatcaaccccgacggctccctgctgttccgcgtaaccatcaacggagtgacc

SEQUENCE LISTING

SEQ ID NO: 283 (L27V CP 160 TEV)
MGWRLCERILAGSSGGGSSGGEPTTENLYFQSDNGSSGGGSSGGMVFTLEDFVGDWRQTAGYNLDQVLEQGGVSSLFQ
NLGVSVTPIQRIVLSGENGLKIDIHVIIPYEGLSGDQMGQIEKIFKVVYPVDDHHFKVILHYGTLVIDGVTPNMIDYF
GRPYEGIAVFDGKKITVTGTLWNGNKIIDERLINPDGSLLFRVTINGVT

SEQ ID NO: 284 (L27V CP 163 TEV)
atgctgtgcgagcgcatttggcgggaagttctggtggaggaagttctggtggagagcctactactgagaacttgtac
ttccagagcgataacggaagttctggtggaggaagttctggtggaatggtgtttacactcgaagatttcgtaggggac
tggcggcagacagccggctacaacctggaccaagtccttgagcagggcggtgtgtccagtttgtttcagaatctcggg
gtgtccgtaactccgatccaaaggattgtcctgagcggtgaaaacggcctgaagatcgacatccatgtcatcatcccg
tatgaaggtctgagcggcgatcagatgggccagatcgaaaaaattttaaggtggtgtaccctgtggatgatcatcac
tttaaggtgattctgcactatggcacactggtaatcgacggggttacgccgaacatgatcgactatttcggacggccg
tatgaaggcatcgccgtgttcgacggcaaaaagatcactgtaaccgggaccctgtggaacggcaacaaaattatcgac
gagcgcctgatcaaccccgacggctccctgctgttccgcgtaaccatcaacggagtgaccggctggcgg SEQ ID NO: 285 (L27V CP 163 TEV)
MLCERILAGSSGGGSSGGEPTTENLYFQSDNGSSGGGSSGGMVFTLEDFVGDWRQTAGYNLDQVLEQGGVSSLFQNLG
VSVTPIQRIVLSGENGLKIDIHVIIPYEGLSGDQMGQIEKIFKVVYPVDDHHFKVILHYGTLVIDGVTPNMIDYFGRP
YEGIAVFDGKKITVTGTLWNGNKIIDERLINPDGSLLFRVTINGVTGWR SEQ ID NO: 286 (L27V CP 166 TEV)
Atgcgcatttggcgggaagttctggtggaggaagttctggtggagagcctactactgagaacttgtacttccagagc
gataacggaagttctggtggaggaagttctggtggaatggtgtttacactcgaagatttcgtaggggactggcggcag
acagccggctacaacctggaccaagtccttgagcagggcggtgtgtccagtttgtttcagaatctcggggtgtccgta
actccgatccaaaggattgtcctgagcggtgaaaacggcctgaagatcgacatccatgtcatcatcccgtatgaaggt
ctgagcggcgatcagatgggccagatcgaaaaaattttaaggtggtgtaccctgtggatgatcatcactttaaggtg
attctgcactatggcacactggtaatcgacggggttacgccgaacatgatcgactatttcggacggccgtatgaaggc
atcgccgtgttcgacggcaaaaagatcactgtaaccgggaccctgtggaacggcaacaaaattatcgacgagcgcctg
atcaaccccgacggctccctgctgttccgcgtaaccatcaacggagtgaccggctggcggctgtgcgag SEQ ID NO: 287 (L27V CP 166 TEV)
MRILAGSSGGGSSGGEPTTENLYFQSDNGSSGGGSSGGMVFTLEDFVGDWRQTAGYNLDQVLEQGGVSSLFQNLGVSV
TPIQRIVLSGENGLKIDIHVIIPYEGLSGDQMGQIEKIFKVVYPVDDHHFKVILHYGTLVIDGVTPNMIDYFGRPYEG
IAVFDGKKITVTGTLWNGNKIIDERLINPDGSLLFRVTINGVTGWRLCE SEQ ID NO: 288 (pCA 9 FKBP-L27V02A 157-169)
gagtgcaggtggaaaccatctccccaggagacgggcgcaccttccccaagcgcggccagacctgcgtggtgcactaca
ccgggatgcttgaagatggaaagaaatttgattcctcccgggacagaaacaagcccttaagtttatgctaggcaagc
aggaggtgatccgaggctgggaagaaggggttgcccagatgagtgtgggtcagagagccaaactgactatatctccag
attatgcctatggtgccactgggcaccccaggcatcatcccaccacatgccactctcgtcttcgatgtggagcttctaa
aactggaaggaggagggagctccggtggaggcagcggtggagtgaccggctggcggctgtgcgaacgcattctggcg SEQ ID NO: 289 (pCA 9 FKBP-L27V02A 157-169)
GVQVETISPGDGRTFPKRGQTCVVHYTGMLEDGKKFDSSRDRNKPFKFMLGKQEVIRGWEEGVAQMSVGQRAKLTISP
DYAYGATGHPGIIPPHATLVFDVELLKLEGGGSSGGGSGGVTGWRLCERILA SEQ ID NO: 290 (pCA 10 L27V02A 1-156-FRB)
atggtcttcacactcgaagatttcgttggggactggcgacagacagccggctacaacctggaccaagtccttgaacag
ggaggtgtgtccagtttgtttcagaatctcggggtgtcgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggaccctgtggaacggcaacaaaattatcgacgagcgcctgatcaaccccgacggctccctgctgttccgagtaacc
atcaacggagtgaccggaggtggctcaggtggaggagctccgtggccatcctctggcatgagatgtggcatgaa
ggcctggaagaggcatctcgtttgtactttggggaaaggaacgtgaaaggcatgtttgaggtgctggagcccttgcat
gctatgatggaacgggccccagactctgaaggaaacatccttaatcaggcctatggtcgagatttaatggaggcc
caagagtggtgcaggaagtacatgaaatcagggaatgtcaaggacctcacccaagcctgggacctctattatcatgtg
ttccgacgaatctca SEQ ID NO: 291 (pCA 10 L27V02A 1-156-FRB)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINPDGSLLFRVT
INGVTGGGGSGGGSSVAILWHEMWHEGLEEASRLYFGERNVKGMFEVLEPLHAMMERGPQTLKETSFNQAYGRDLMEA
QEWCRKYMKSGNVKDLTQAWDLYYHVFRRIS SEQ ID NO: 292 (pCA 26 FKBP-L27V02A 1-156)
ggagtgcaggtggaaaccatctccccaggagacgggcgcaccttccccaagcgcggccagacctgcgtggtgcactac
accgggatgcttgaagatggaaagaaatttgattcctcccgggacagaaacaagcccttaagtttatgctaggcaag
caggaggtgatccgaggctgggaagaaggggttgcccagatgagtgtgggtcagagagccaaactgactatatctcca
gattatgcctatggtgccactgggcaccccaggcatcatccaccacatgccactctcgtcttcgatgtggagcttcta
aaactggaaggaggagggagctccggtggaggcagcggtggtcttcacactcgaagatttcgttggggactggcga
cagacagccggctacaacctggaccaagtccttgaacagggaggtgtgtccagtttgtttcagaatctcggggtgtcc
gtaactccgatccaaaggattgtcctgagcggtgaaaatgggctgaagatcgacatccatgtcatcatcccgtatgaa
ggtctgagcggcgaccaaatgggccagatcgaaaaaattttaaggtggtgtaccctgtggatgatcatcactttaag
gtgatcctgcactatggcacactggtaatcgacggggttacgccgaacatgatcgactatttcggacggccgtatgaa

```
                            SEQUENCE LISTING
ggcatcgccgtgttcgacggcaaaaagatcactgtaacagggaccctgtggaacggcaacaaaattatcgacgagcgc
ctgatcaaccccgacggctccctgctgttccgagtaaccatcaac SEQ ID NO: 293 (pCA 26 FKBP-L27V02A 1-156)
GVQVETISPGDGRTFPKRGQTCVVHYTGMLEDGKKFDSSRDRNKPFKFMLGKQEVIRGWEEGVAQMSVGQRAKLTISP
DYAYGATGHPGIIPPHATLVFDVELLKLEGGGSSGGGSGMVFTLEDFVGDWRQTAGYNLDQVLEQGGVSSLFQNLGVS
VTPIQRIVLSGENGLKIDIHVIIPYEGLSGDQMGQIEKIFKVVYPVDDHHFKVILHYGTLVIDGVTPNMIDYFGRPYE
GIAVFDGKKITVTGTLWNGNKIIDERLINPDGSLLFRVTIN SEQ ID NO: 294 (pCA 25 L27V02A 157-169-FRB)
atgggagtgaccggctggcggctgtgcgaacgcattctggcggggaggaggtggctcaggtggagggagctccgtggcc
atcctctggcatgagatgtggcatgaaggcctggaagaggcatctcgtttgtactttggggaaaggaacgtgaaaggc
atgtttgaggtgctggagcccttgcatgctatgatggaacggggcccccagactctgaaggaaacatcctttaatcag
gcctatggtcgagatttaatggaggcccaagagtggtgcaggaagtacatgaaatcagggaatgtcaaggacctcacc
caagcctgggacctctattatcatgtgttccgacgaatctca SEQ ID NO: 295 (pCA 25 L27V02A 157-169-FRB)
MGVTGWRLCERILAGGGGSGGGSSVAILWHEMWHEGLEEASRLYFGERNVKGMFEVLEPLHAMMERGPQTLKETSFNQ
AYGRDLMEAQEWCRKYMKSGNVKDLTQAWDLYYHVFRRIS SEQ ID NO: 296 (pCA 3 FKBP-L27V02A 103-169)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtacgccgaacatgatcgactatttcggacggccgtat
gaaggcatcgccgtgttcgacggcaaaaagatcactgtaacagggaccctgtggaacggcaacaaaattatcgacgag
cgcctgatcaaccccgacggctccctgctgttccgagtaaccatcaacggagtgaccggctggcggctgtgcgaacgc
attctggc SEQ ID NO: 297 (pCA 3 FKBP-L27V02A 103-169)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGTPNMIDYFGRPYEGIAVFDGKKITVTGTLWNGNKIIDE
RLINPDGSLLFRVTINGVTGWRLCERIL SEQ ID NO: 298 (pCA 4 L27V02A 1-102-FRB)
atggtcttcacactcgaagatttcgttggggactggcgacagacagccggctacaacctggaccaagtccttgaacag
ggaggtgtgtccagtttgtttcagaatctcggggtgtccgtaactccgactccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
ggaggagtggctcaggtggagggagctccgtggccatcctctggcatgagatgtggcatgaaggcctgaagaggca
tctcgtttgtactttggggaaaggaacgtgaaaggcatgtttgaggtgctggagcccttgcatgctatgatggaacgg
ggcccccagactctgaaggaaacatcctttaatcaggcctatggtcgagatttaatggaggcccaagagtggtgcagg
aagtacatgaaatcagggaatgtcaaggacctcacccaagcctgggacctctattatcatgtgttccgacgaatctca SEQ ID NO: 299 (pCA 4 L27V02A 1-102-FRB)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGTPNMIDYFGRPYEGIAVFDGKKITVTGTLWNGNKIIDE
RLINPDGSLLFRVTINGVTGWRLCERIL SEQ ID NO: 300 (pCA 19 L27V02A 103-169-FRB)
atgacgccgaacatgatcgactatttcggacggccgtatgaaggcatcgccgtgttcgacggcaaaaagatcactgta
acagggaccctgtggaacggcaacaaaattatcgacgagcgcctgatcaaccccgacggctccctgctgttccgagta
accatcaacggagtgaccggctggcggctgtgcgaacgcattctggcggggaggaggtggctcaggtggagggagctcc
gtggccatcctctggcatgagatgtggcatgaaggcctgaagaggcatctcgtttgtactttggggaaaggaacgtg
aaaggcatgtttgaggtgctggagcccttgcatgctatgatggaacggggcccccagactctgaaggaaacatcctt
aatcaggcctatggtcgagatttaatggaggcccaagagtggtgcaggaagtacatgaaatcagggaatgtcaaggac
ctcacccaagcctgggacctctattatcatgtgttccgacgaatctca SEQ ID NO: 301 (pCA 19 L27V02A 103-169-FRB)
MTPNMIDYFGRPYEGIAVFDGKKITVTGTLWNGNKIIDERLINPDGSLLFRVTINGVTGWRLCERILAGGGGSGGGSS
VAILWHEMWHEGLEEASRLYFGERNVKGMFEVLEPLHAMMERGPQTLKETSFNQAYGRDLMEAQEWCRKYMKSGNVKD
LTQAWDLYYHVFRRIS SEQ ID NO: 302 (pCA 20 FKBP-L27V02A 1-102)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatgcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttaaggtggtgtaccctgtggatgatcatcactttt
aaggtgatcctgcactatggcacactggtaatcgacggggtt
```

SEQUENCE LISTING

SEQ ID NO: 303 (pCA 20 FKBP-L27V02A 1-102)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGV

SEQ ID NO: 304 (pCA 11 FKBP-L27V02A 84-169)
atgggagtgcaggtggaaaccatctcccaggagacgggcgcaccttccccaagcgcggccagacctgcgtggtgcac
tacaccgggatgcttgaagatggaaagaaatttgattcctcccgggacagaaacaagcccttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtgatgatcatcactttaaggtgatcctgcactatggc
acactggtaatcgacggggttacgccgaacatgatcgactatttcggacggccgtatgaaggcatcgccgtgttcgac
ggcaaaaagatcactgtaacagggaccctgtggaacggcaacaaaattatcgacgagcgcctgatcaaccccgacggc
tccctgctgttccgagtaaccatcaacggagtgaccggctggcggctgtgcgaacgcattctggcg SEQ ID NO: 305 (pCA 11 FKBP-L27V02A 84-169)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGDDHHFKVILHYGTLVIDGVTPNMIDYFGRPYEGIAVFD
GKKITVTGTLWNGNKIIDERLINPDGSLLFRVTINGVTGWRLCERILA SEQ ID NO: 306 (pCA 12 L27V02A 1-83-FRB)
atggtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtgggaggaggtggctcaggtggagggagctccgtggccatcctctggcatgagatgtgg
catgaaggcctggaagaggcatctcgtttgtactttggggaaaggaacgtgaaaggcatgtttgaggtgctggagccc
ttgcatgctatgatgaacggggccccagactctgaaggaaacatcctttaatcaggcctatggtcgagatttaatg
gaggcccaagagtggtgcaggaagtacatgaaatcagggaatgtcaaggacctcacccaagcctgggacctctattat
catgtgttccgacgaatctca SEQ ID NO: 307 (pCA 12 L27V02A 1-83-FRB)
MVFTLEDFVGDWRQTAGYNLDQVLEQGGVSSLFQNLGVSVTPIQRIVLSGENGLKIDIHVIIPYEGLSGDQMGQIEKI
FKVVYPVGGGGSGGGSSVAILWHEMWHEGLEEASRLYFGERNVKGMFEVLEPLHAMMERGPQTLKETSFNQAYGRDLM
EAQEWCRKYMKSGNVKDLTQAWDLYYHVFRRIS SEQ ID NO: 308 (pCA 14 L27V02A 1-83 (no fusion))
atggtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtg SEQ ID NO: 309 (pCA 14 L27V02A 1-83 (no fusion))
MVFTLEDFVGDWRQTAGYNLDQVLEQGGVSSLFQNLGVSVTPIQRIVLSGENGLKIDIHVIIPYEGLSGDQMGQIEKI
FKVVYPV SEQ ID NO: 310 (pCA 13 L27V02A 84-169 (no fusion))
atggatgatcatcactttaaggtgatcctgcactatggcacactggtaatcgacggggttacgccgaacatgatcgac
tatttcggacggccgtatgaaggcatcgccgtgttcgacggcaaaaagatcactgtaacagggaccctgtggaacggc
aacaaaattatcgacgagcgcctgatcaaccccgacggctccctgctgttccgagtaaccatcaacggagtgaccggc
tggcggctgtgcgaacgcattctggcg SEQ ID NO: 311 (pCA 13 L27V02A 84-169 (no fusion))
MDDHHFKVILHYGTLVIDGVTPNMIDYFGRPYEGIAVFDGKKITVTGTLWNGNKIIDERLINPDGSLLFRVTINGVTG
WRLCERILA SEQ ID NO: 312 (pCA 28 FKBP 1-83)
atgggagtgcaggtggaaaccatctcccaggagacgggcgcaccttccccaagcgcggccagacctgcgtggtgcac
tacaccgggatgcttgaagatggaaagaaatttgattcctcccgggacagaaacaagcccttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttttaaggtggtgtaccctgtg SEQ ID NO: 313 (pCA 28 FKBP 1-83)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPV SEQ ID NO: 314 (pCA 27 L27V02A 84-169 FRB)
atggatgatcatcactttaaggtgatcctgcactatggcacactggtaatcgacggggttacgccgaacatgatcgac
tatttcggacggccgtatgaaggcatcgccgtgttcgacggcaaaaagatcactgtaacagggaccctgtggaacggc
aacaaaattatcgacgagcgcctgatcaaccccgacggctccctgctgttccgagtaaccatcaacggagtgaccggc
tggcggctgtgcgaacgcattctggcggggaggaggtggctcaggtggagggagctccgtggccatcctctggcatgag
atgtggcatgaaggcctggaagaggcatctcgtttgtactttggggaaaggaacgtgaaaggcatgtttgaggtgctg

SEQUENCE LISTING gagcccttgcatgctatgatggaacggggcccccagactctgaaggaaacatcctttaatcaggcctatggtcgagat
ttaatggaggcccaagagtggtgcaggaagtacatgaaatcagggaatgtcaaggacctcacccaagcctgggacctc
tattatcatgtgttccgacgaatctca SEQ ID NO: 315 (pCA 27 L27V02A 84-169 FRB)
MDDHHFKVILHYGTLVIDGVTPNMIDYFGRPYEGIAVFDGKKITVTGTLWNGNKIIDERLINPDGSLLFRVTINGVTG
WRLCERILAGGGGSGGGSSVAILWHEMWHEGLEEASRLYFGERNVKGMFEVLEPLHAMMERGPQTLKETSFNQAYGRD
LMEAQEWCRKYMKSGNVKDLTQAWDLYYHVFRRIS SEQ ID NO: 316 (HT7-Keap1)
atggcagaaatcggtactggctttccattcgaccccccattatgtggaagtcctgggcgagcgcatgcactacgtcgat
gttggtccgcgcgatggcaccctgtgctgttcctgcacggtaaacccgacctcctcctacgtgtggcgcaacatcatc
ccgcatgttgcaccgacccatcgctgcattgctccagacctgatcggtatgggcaaatccgacaaaccagacctgggt
tatttcttcgacgaccacgtccgcttcatggatgccttcatcgaagcctgggtctggaagaggtcgtcctggtcatt
cacgactggggctccgctctgggtttccactgggccaagcgcaatccagagcgcgtcaaaggtattgcatttatggag
ttcatccgccctatcccgacctgggacgaatggccagaatttgcccgcgagaccttccaggccttccgcaccaccgac
gtcggccgcaagctgatcatcgatcagaacgtttttatcgagggtacgctgccgatgggtgtcgtccgcccgctgact
gaagtcgagatggaccattaccgcgagccgttcctgaatcctgttgaccgcgagccactgtggcgcttcccaaacgag
ctgccaatcgccggtgagccagcgaacatcgtcgcgctggtcgaagaatacatggactggctgcaccagtccctgtc
ccgaagctgctgttctgggggcaccccaggctctgatccaccggccgaagccgctcgcctggccaaaagcctgcct
aactgcaaggctgtggacatcggcccgggtctgaatctgctgcaagaagacaacccggacctgatcggcagcgagatc
gcgcgctggctgtcgacgctcgagatttccggcgagccaaccactgaggatctgtactttcagagcgataacgcgatc
gctttcgaaggagatagaaccatgcagccagatcccaggcctagcggggctggggcctgctgccgattcctgcccctg
cagtcacagtgccctgaggggggcagggggacggtgatgtacgcctccactgagtgcaagggggaggtgacgccctcc
cagcatggcaaccgcaccttcagctacaccctggaggatcataccaagcaggcctttggcatcatgaacgagctgcgg
ctcagccagcagctgtgtgacgtcacactgcaggtcaagtaccaggatgcaccggccgcccagttcatggcccacaag
gtggtgctggcctcatccagccctgtttcaaggccatgttcaccaacgggctgcgggagcagggcatggaggtggtg
tccattgagggtatccaccccaagtcatggagcgcctcattgaattcgctacacggcctccatctccatgggcgag
aagtgtgtcctccacgtcatgaacggcgctgtcatgtaccagatcgacagcgttgtccgtgcctgcagtgacttcctg
gtgcagcagctggaccccagcaatgccatcggcatcgccaacttcgctgagcagattggctgtgtggagttgcaccag
cgtgcccgggagtacatctacatgcattttggggaggtggccaagcaagaggagttcttcaacctgtcccactgccaa
ctggtgaccctcatcagccgggacgacctgaacgtgcgctgcgagtccgaggtcttccacgcctgcatcaactgggtc
aagtacgactgcgaacagcgacggttctacgtccaggcgctgctgcgggccgtgcgctgccactcgttgacgccgaac
ttcctgcagatgcagctgcagaagtgcgagatcctgcagtccgactcccgctgcaaggactacctggtcaagatcttc
gaggagctcaccctgcacaagcccacgcaggtgatgcctgccgggcgcccaaggtgggccgcctgatctacaccgcg
ggcggctacttccgacagtcgctcagctacctggaggcttacaacccagtaacggcacctggctccggttggcggac
ctgcaggtgccgcggagcggcctggccggctgcgtggtgggcggcgtgttgtacgccgtgggcggcaggaacaactcg
cccgacggcaacaccgactccagcgccctggactgttacaaccccatgaccaatcagtggtcgcctgcgccccatg
agcgtgccccgtaaccgcatcggggtgggggtcatcgatggccacatctatgccgtcggcggctcccacggctgcatc
caccacaacagtgtggagaggtatgagccagagcgggatgagtggcacttggtggcccaatgctgacacgaaggatc
gggggtgggcgtggctgtcctcaatcgtctgctttatgccgtgggggggcttgacgggacaaaccgccttaattcagct
gagtgttactacccagagagagaacgagtggcgaatgatcacagcaatgaacaccatccgaagcggggcaggcgtctgc
gtcctgcacaactgtatctatgctgctggggggctatgatggtcaggaccagctgaacagcgtggagcgctacgatgtg
gaaacagagacgtggactttcgtagccccatgaagcaccggcgaagtgccctggggatcactgtccaccaggggaga
atctacgtccttggaggctatgatggtcacacgttcctggacagtgtggagtgttacgacccagatacagacacctgg
agcgaggtgacccgaatgacatcggggccggagtggggtgggcgtggctgtcaccatggagccctgccggaagcagatt
gaccagcagaactgtacctgttacgtagtt SEQ ID NO: 317 (Nrf2)
TCAATATTGGCCATTAGCCATATTATTCATTGGTTATATAGCATAAATCAATATTGGCTATTGGCCATTGCATACGTT
GTATCTATATCATAATATGTACATTTATATTGGCTCATGTCCAATATGACCGCCATGTTGGCATTGATTATTGACTAG
TTATTAATAGTAATCAATTACGGGGTCATTAGTTCATAGCCCATATATGGAGTTCCGCGTTACATAACTTACGGTAAA
TGGCCCGCCTGGCTGACCGCCCAACGACCCCCGCCCATTGACGTCAATAATGACGTATGTTCCCATAGTAACGCCAAT
AGGGACTTTCCATTGACGTCAATGGGTGGAGTATTTACGGTAAACTGCCCACTTGGCAGTACATCAAGTGTATCATAT
GCCAAGTCCGCCCCCTATTGACGTCAATGACGGTAAATGGCCCGCCTGGCATTATGCCCAGTACATGACCTTACGGGA
CTTTCCTACTTGGCAGTACATCTACGTATTAGTCATCGCTATTACCATGGTGATGCGGTTTTGGCAGTACACCAATGG
GCGTGGATAGCGGTTTGACTCACGGGGATTTCCAAGTCTCCACCCCATTGACGTCAATGGGAGTTTGTTTTGGCACCA
AAATCAACGGGACTTTCCAAAATGTCGTAATAACCCCGCCCCGTTGACGCAAATGGGCGGTAGGCGTGTACGGTGGGA
GGTCTATATAAGCAGAGCTGGTTTAGTGAACCGTCAGATCACTAGAAGCTTTATTGCGGTAGTTTATCACAGTTAAAT
TGCTAACGCAGTCAGTGCTTCTGACACAACAGTCTCGAACTTAAGCTGCAGAAGTTGGTCGTGAGGCACTGGGCAGGT
AAGTATCAAGGTTACAAGACAGGTTTAAGGAGACCAATAGAAACTGGGCTTGTGCAGACAGAGAAGACTCTTGCGTTT
CTGATAGGCACCTATTGGTCTTACTGACATCCACTTTGCCTTTCTCTCCACAGGTGTCCACTCCCAGTTCAATTACAG
CTCTTAAGGCTAGAGTATTAATACGACTCACTATAGGGCTAGCGATCGCCATGATGGACTTGGAGCTGCCGCCGCGG
GACTCCCGTCCCAGCAGGACATGGATTTGATTGACATACTTTGGAGGCAAGATATAGATCTTGGAGTAAGTCGAGAAG
TATTTGACTTCAGTCAGCGACGGAAAGAGTATGAGCTGGAAAAACAGAAAAAACTTGAAAAGGAAAGACAAGAACAAC
TCCAAAAGGAGCAAGAGAAAGCCTTTTTCGCTCAGTTACAACTAGATAGAAAGACAGGTGAATTTCTCCCAATTCAGC
CAGCCCAGCACATCCAGTCAGAAACCAGTTCTCTCGGTGGTTCAGGTGGTGGCGGGAGCGGTGGAGGGAGCAGCGGTG
GAGTGTTTACACTCGAAGATTTCGTAGGGGACTGGCGGCAGACAGCCGGCTACAACCTGGACCAAGTCCTTGAGCAGG
GCGGTGTGTCCAGTTTGTTTCAGAATCTCGGGGTGTCCGTAACTCCGATCCAAAGGATTGTCCTGAGCGGTGAAAACG
GCCTGAAGATCGACATCCATGTCATCATCCCGTATGAAGGTCTGAGCGGCGATCAGATGGGCCAGATCGAAAAAATTT
TTAAGGTGGTGTACCCTGTGGATGATCATCACTTTAAGGTGATTCTGCACTATGGCACACTGGTAATCGACGGGGTTA
CGCCGAACATGATCGACTATTTCGGACGGCCTATGAAGGCATCGCCGTGTTCGACGGCAAAAAGATCACTGTAACCG
GGACCCTGTGGAACGGCAACAAAATTATCGACGAGCGCCTGATCAACCCCGACGGCTCCCTGCTGTTCCGCGTAACCA
TCAACGGAGTGACCGGCTGGCGGCTGTGCGAGCGCATTTTGGCGTAAGGCCGCGACTCTAGAGTCGACCTGCAGGCAT
GCAAGCTGATCCGGCTGCTAACAAAGCCCGAAAGGAAGCTGAGTTGGCTGCTGCCACCGCTGAGCAATAACTAGCATA
ACCCCTTGGGGCGGCCGCTTCGAGCAGACATGATAAGATACATTGATGAGTTTGGACAAACCACAACTAGAATGCAGT
GAAAAAAATGCTTTATTTGTGAAATTTGTGATGCTATTGCTTTATTTGTAACCATTATAAGCTGCAATAAACAAGTTA

```
ACAACAACAATTGCATTCATTTTATGTTTCAGGTTCAGGGGGAGATGTGGGAGGTTTTTTTAAGCAAGTAAAACCTCT
ACAAATGTGGTAAAATCGAATTTTAACAAAATATTAACGCTTACAATTTCCTGATGCGGTATTTTCTCCTTACGCATC
TGTGCGGTATTTCACACCGCATACGCGGATCTGCGCAGCACCATGGCCTGAAATAACCTCTGAAAGAGGAACTTGGTT
AGGTACCTTCTGAGGCGGAAAGAACCAGCTGTGGAATGTGTGTCAGTTAGGGTGTGGAAAGTCCCCAGGCTCCCCAGC
AGGCAGAAGTATGCAAAGCATGCATCTCAATTAGTCAGCAACCAGGTGTGGAAAGTCCCCAGGCTCCCCAGCAGGCAG
AAGTATGCAAAGCATGCATCTCAATTAGTCAGCAACCATAGTCCCGCCCCTAACTCCGCCCATCCCGCCCCTAACTCC
GCCCAGTTCCGCCCATTCTCCGCCCCATGGCTGACTAATTTTTTTTATTTATGCAGAGGCCGAGGCCGCCTCGGCCTC
TGAGCTATTCCAGAAGTAGTGAGGAGGCTTTTTTGGAGGCCTAGGCTTTTGCAAAAAGCTTAATTAACTGTTGACAAT
TAATCATCGGCATAGTATATCGGCATAGTATAATACGACAAGGTGAGGAACTAAACCCAGGAGGCAGATCATGATTGA
ACAAGATGGATTGCACGCAGGTTCTCCGGCCGCTTGGGTGGAGAGGCTATTCGGCTATGACTGGGCACAACAGACAAT
CGGCTGCTCTGATGCCGCCGTGTTCCGGCTGTCAGCGCAGGGGCGCCCGGTTCTTTTTGTCAAGACCGACCTGTCCGG
TGCCCTGAATGAACTGCAGGACGAGGCAGCGCGGCTATCGTGGCTGGCCACGACGGGCGTTCCTTGCGCAGCTGTGCT
CGACGTTGTCACTGAAGCGGGAAGGGACTGGCTGCTATTGGGCGAAGTGCCGGGGCAGGATCTCCTGTCATCTCACCT
TGCTCCTGCCGAGAAAGTATCCATCATGGCTGATGCAATGCGGCGGCTGCATACGCTTGATCCGGCTACCTGCCCATT
CGACCACCAAGCGAAACATCGCATCGAGCGAGCACGTACTCGGATGGAAGCCGGTCTTGTCGATCAGGATGATCTGGA
CGAAGAGCATCAGGGGCTCGCGCCAGCCGAACTGTTCGCCAGGCTCAAGGCGCGCATGCCCGACGGCGAGGATCTCGT
CGTGACCCATGGCGATGCCTGCTTGCCGAATATCATGGTGGAAAATGGCCGCTTTTCTGGATTCATCGACTGTGGCCG
GCTGGGTGTGGCGGACCGCTATCAGGACATAGCGTTGGCTACCCGTGATATTGCTGAAGAGCTTGGCGGCGAATGGGC
TGACCGCTTCCTCGTGCTTTACGGTATCGCCGCTCCCGATTCGCAGCGCATCGCCTTCTATCGCCTTCTTGACGAGTT
CTTCTGAGCGGGACTCTGGGGTTCGAAATGACCGACCAAGCGACGCCCAACCTGCCTCACGATGGCCGCAATAAAAT
ATCTTTATTTTCATTACATCTGTGTGTTGGTTTTTTGTGTGAATCGATAGCGATAAGGATCCTCTTTGCGCTTGCGTT
TTCCCTTGTCCAGATAGCCCAGTAGCTGACATTCATCCGGGGTCAGCACCGTTTCTGCGGACTGGCTTTCTACCCGGT
ATCAGCTCACTCAAAGGCGGTAATACGGTTATCCACAGAATCAGGGGATAACGCAGGAAAGAACATGTGAGCAAAAGG
CCAGCAAAAGGCCAGGAACCGTAAAAAGGCCGCGTTGCTGGCGTTTTTCCATAGGCTCCGCCCCCCTGACGAGCATCA
CAAAAATCGACGCTCAAGTCAGAGGTGGCGAAACCCGACAGGACTATAAAGATACCAGGCGTTTCCCCCTGGAAGCTC
CCTCGTGCGCTCTCCTGTTCCGACCCTGCCGCTTACCGGATACCTGTCCGCCTTTCTCCCTTCGGGAAGCGTGGCGCT
TTCTCATAGCTCACGCTGTAGGTATCTCAGTTCGGTGTAGGTCGTTCGCTCCAAGCTGGGCTGTGTGCACGAACCCCC
CGTTCAGCCCGACCGCTGCGCCTTATCCGGTAACTATCGTCTTGAGTCCAACCCGGTAAGACACGACTTATCGCCACT
GGCAGCAGCCACTGGTAACAGGATTAGCAGAGCGAGGTATGTAGGCGGTGCTACAGAGTTCTTGAAGTGGTGGCCTAA
CTACGGCTACACTAGAAGGACAGTATTTGGTATCTGCGCTCTGCTGAAGCCAGTTACCTTCGGAAAAAGAGTTGGTAG
CTCTTGATCCGGCAAACAAACCACCGCTGGTAGCGGTGGTTTTTTTGTTTGCAAGCAGCAGATTACGCGCAGAAAAAA
AGGATTTCAAGAAGATCCTTTGATCTTTTCTACGGGGTCTGACGCTCAGTGGAACGAAAACTCACGTTAAGGGATTTT
GGTCATGAGATTATCAAAAAGGATCTTCACCTAGATCCTTTTATAGTCCGGAAATACAGGAACGCACGCTGGATGGCC
CTTCGCTGGATGGTGAAACCATGAAAAATGGCAGCTTCAGTGGATTAAGTGGGGGTAATGTGGCCTGTACCCTCTGG
TTGCATAGGTATTCATACGGTTAAAATTTATCAGGCGCGATTGCGGCAGTTTTTCGGGTGGTTTGTTGCCATTTTTAC
CTGTCTGCTGCCGTGATCGCGCTGAACGCGTTTTAGCGGTGCGTACAATTAAGGGATTATGGTAAATCCACTTACTGT
CTGCCCTCGTAGCCATCGAGATAAACCGCAGTACTCCGGCCACGATGCGTCCGGCGTAGAGGATCGAGATCT

SEQ ID NO: 318 (L27V02B)
ATGGTCTTCACACTCGAAGATTTCGTAGGTGACTGGCGACAGACAGCCGGCTACAACCTGGACCAAGTCCTTGAACAG
GGTGGTGTGTCCAGTTTGTTTCAGAATCTCGGGGTGTCCGTAACTCCGATCCAAAGGATTGTCCTGAGCGGTGAAAAT
GGGCTGAAGATCGACATCCATGTCATCATCCCGTATGAAGGTCTGAGCGGCGACCAAATGGGCCAGATCGAAAAAATT
TTTAAGGTGGTGTACCCTGTGGATGATCATCACTTTAAGGTGATCCTGCACTATGGCACACTGGTAATCGACGGGGTT
ACGCCGAACATGATCGACTATTTCGGACGGCCGTATGAAGGCATCGCCGTGTTCGACGGCAAAAAGATCACTGTAACT
GGGACCCTGTGGAACGGCAACAAAATTATCGACGAGCGCCTGATCAACCCCGACGGCTCCCTGCTGTTCCGAGTAACC
ATCAACGGAGTGACCGGCTGGCGGCTGTGCGAACGCATTCTGGCG

SEQ ID NO: 319 (L27V01)
ATGGTGTTTACACTCGAAGATTTCGTAGGGGACTGGCGGCAGACAGCCGGCTACAACCTGGACCAAGTCCTTGAACAG
GGCGGTGTGTCCAGTTTGTTTCAGAATCTCGGGGTGTCCGTAACTCCGATCCAAAGGATTGTCCTGAGCGGTGAAAAC
GGCCTGAAGATCGACATCCATGTCATCATCCCGTATGAAGGTCTGAGCGGCGATCAAATGGGCCAGATCGAAAAAATT
TTTAAGGTGGTGTACCCTGTGGATGATCATCACTTTAAGGTGATCCTGCACTATGGCACACTGGTAATCGACGGGGTT
ACGCCGAACATGATCGACTATTTCGGACGGCCGTATGAAGGCATCGCCGTGTTCGACGGCAAAAAGATCACTGTAACC
GGGACCCTGTGGAACGGCAACAAAATTATCGACGAGCGCCTGATCAACCCCGACGGCTCCCTGCTGTTCCGCGTAACC
ATCAACGGAGTGACCGGCTGGCGGCTGTGCGAGCGCATTTTGGCG

SEQ ID NO: 320 (L27V01-PEST00)
ATGGTGTTTACACTCGAAGATTTCGTAGGGGACTGGCGGCAGACAGCCGGCTACAACCTGGACCAAGTCCTTGAACAG
GGCGGTGTGTCCAGTTTGTTTCAGAATCTCGGGGTGTCCGTAACTCCGATCCAAAGGATTGTCCTGAGCGGTGAAAAC
GGCCTGAAGATCGACATCCATGTCATCATCCCGTATGAAGGTCTGAGCGGCGATCAAATGGGCCAGATCGAAAAAATT
TTTAAGGTGGTGTACCCTGTGGATGATCATCACTTTAAGGTGATCCTGCACTATGGCACACTGGTAATCGACGGGGTT
ACGCCGAACATGATCGACTATTTCGGACGGCCGTATGAAGGCATCGCCGTGTTCGACGGCAAAAAGATCACTGTAACC
GGGACCCTGTGGAACGGCAACAAAATTATCGACGAGCGCCTGATCAACCCCGACGGCTCCCTGCTGTTCCGCGTAACC
ATCAACGGAGTGACCGGCTGGCGGCTGTGCGAGCGCATTTTGGCGAATTCACACGGCTTTCCGCCCGAGGTTGAAGAG
CAAGCCGCCGGTACATTGCCTATGTCCTGCGCACAAGAAAGCGGTATGGACCGGCACCCAGCCGCTTGTGCTTCAGCT
CGCATCAACGTC

SEQ ID NO: 321 (IL601-L27V01)
ATGAACTCCTTCTCCACAAGCGCCTTCGGTCCAGTTGCCTTCTCCCTGGGCCTGCTCCTGGTGTTGCCTGCTGCCTTC
CCTGCCCCAGTGTTTACACTCGAAGATTTCGTAGGGGACTGGCGGCAGACAGCCGGCTACAACCTGGACCAAGTCCTT
GAACAGGGCGGTGTGTCCAGTTTGTTTCAGAATCTCGGGGTGTCCGTAACTCCGATCCAAAGGATTGTCCTGAGCGGT
GAAAACGGCCTGAAGATCGACATCCATGTCATCATCCCGTATGAAGGTCTGAGCGGCGATCAAATGGGCCAGATCGAA
AAAATTTTTAAGGTGGTGTACCCTGTGGATGATCATCACTTTAAGGTGATCCTGCACTATGGCACACTGGTAATCGAC
GGGGTTACGCCGAACATGATCGACTATTTCGGACGGCCGTATGAAGGCATCGCCGTGTTCGACGGCAAAAAGATCACT
GTAACCGGGACCCTGTGGAACGGCAACAAAATTATCGACGAGCGCCTGATCAACCCCGACGGCTCCCTGCTGTTCCGC
GTAACCATCAACGGAGTGACCGGCTGGCGGCTGTGCGAGCGCATTTTGGCG
```

SEQUENCE LISTING

SEQ ID NO: 322 (L27V02A)
ATGGTCTTCACACTCGAAGATTTCGTTGGGGACTGGCGACAGACAGCCGGCTACAACCTGGACCAAGTCCTTGAACAG
GGAGGTGTGTCCAGTTTGTTTCAGAATCTCGGGGTGTCCGTAACTCCGATCCAAAGGATTGTCCTGAGCGGTGAAAAT
GGGCTGAAGATCGACATCCATGTCATCATCCCGTATGAAGGTCTGAGCGGCGACCAAATGGGCCAGATCGAAAAAATT
TTTAAGGTGGTGTACCCTGTGGATGATCATCACTTTAAGGTGATCCTGCACTATGGCACACTGGTAATCGACGGGGTT
ACGCCGAACATGATCGACTATTTCGGACGGCCGTATGAAGGCATCGCCGTGTTCGACGGCAAAAAGATCACTGTAACA
GGGACCCTGTGGAACGGCAACAAAATTATCGACGAGCGCCTGATCAACCCCGACGGCTCCCTGCTGTTCCGAGTAACC
ATCAACGGAGTGACCGGCTGGCGGCTGTGCGAACGCATTCTGGCG

SEQ ID NO: 323 (L27V02A-PEST01)
ATGGTCTTCACACTCGAAGATTTCGTTGGGGACTGGCGACAGACAGCCGGCTACAACCTGGACCAAGTCCTTGAACAG
GGAGGTGTGTCCAGTTTGTTTCAGAATCTCGGGGTGTCCGTAACTCCGATCCAAAGGATTGTCCTGAGCGGTGAAAAT
GGGCTGAAGATCGACATCCATGTCATCATCCCGTATGAAGGTCTGAGCGGCGACCAAATGGGCCAGATCGAAAAAATT
TTTAAGGTGGTGTACCCTGTGGATGATCATCACTTTAAGGTGATCCTGCACTATGGCACACTGGTAATCGACGGGGTT
ACGCCGAACATGATCGACTATTTCGGACGGCCGTATGAAGGCATCGCCGTGTTCGACGGCAAAAAGATCACTGTAACA
GGGACCCTGTGGAACGGCAACAAAATTATCGACGAGCGCCTGATCAACCCCGACGGCTCCCTGCTGTTCCGAGTAACC
ATCAACGGAGTGACCGGCTGGCGGCTGTGCGAACGCATTCTGGCGAATTCTCACGGCTTTCCGCCTGAGGTTGAAGAG
CAAGCCGCCGGTACATTGCCTATGTCCTGCGCACAAGAAAGCGGTATGGACCGGCACCCAGCCGCTTGTGCTTCAGCT
CGCATCAACGTC

SEQ ID NO: 324 (IL601-L27V02A)
ATGAACTCCTTCTCCACAAGCGCCTTCGGTCCAGTTGCCTTCTCCCTGGGCCTGCTCCTGGTGTTGCCTGCTGCCTTC
CCTGCCCCAGTCTTCACACTCGAAGATTTCGTTGGGGACTGGCGACAGACAGCCGGCTACAACCTGGACCAAGTCCTT
GAACAGGGAGGTGTGTCCAGTTTGTTTCAGAATCTCGGGGTGTCCGTAACTCCGATCCAAAGGATTGTCCTGAGCGGT
GAAAATGGGCTGAAGATCGACATCCATGTCATCATCCCGTATGAAGGTCTGAGCGGCGACCAAATGGGCCAGATCGAA
AAAATTTTTAAGGTGGTGTACCCTGTGGATGATCATCACTTTAAGGTGATCCTGCACTATGGCACACTGGTAATCGAC
GGGGTTACGCCGAACATGATCGACTATTTCGGACGGCCGTATGAAGGCATCGCCGTGTTCGACGGCAAAAAGATCACT
GTAACAGGGACCCTGTGGAACGGCAACAAAATTATCGACGAGCGCCTGATCAACCCCGACGGCTCCCTGCTGTTCCGA
GTAACCATCAACGGAGTGACCGGCTGGCGGCTGTGCGAACGCATTCTGGCG

SEQ ID NO: 325 (L27V03)
ATGGTCTTCACACTCGAAGATTTCGTAGGTGACTGGCGACAGACAGCCGGCTACAACCTGGACCAAGTTCTTGAACAG
GGTGGTGTGTCCAGTTTGTTTCAGAATCTCGGGGTGTCCGTAACTCCAATCCAGAGGATAGTCCTGAGTGGTGAAAAT
GGGCTGAAGATCGACATCCATGTCATCATCCCTTATGAAGGTCTGAGCGGCGATCAGATGGGGCAGATCGAAAAAATT
TTTAAGGTGGTGTACCCTGTGGATGATCATCACTTTAAGGTGATCCTGCACTATGGCACACTGGTAATCGACGGTGTT
ACGCCGAACATGATCGACTATTTCGGACGGCCGTATGAAGGCATCGCCGTGTTCGACGGCAAAAAGATTACTGTCACT
GGAACCCTGTGGAATGGGAACAAAATTATCGACGAGCGCCTGATCAACCCCGACGGCTCACTGCTGTTCCGAGTAACC
ATCAATGGTGTTACCGGCTGGCGGCTCTGCGAACGCATTCTAGCA

SEQ ID NO: 326 (L27V03-PEST02)
ATGGTCTTCACACTCGAAGATTTCGTAGGTGACTGGCGACAGACAGCCGGCTACAACCTGGACCAAGTTCTTGAACAG
GGTGGTGTGTCCAGTTTGTTTCAGAATCTCGGGGTGTCCGTAACTCCAATCCAGAGGATAGTCCTGAGTGGTGAAAAT
GGGCTGAAGATCGACATCCATGTCATCATCCCTTATGAAGGTCTGAGCGGCGATCAGATGGGGCAGATCGAAAAAATT
TTTAAGGTGGTGTACCCTGTGGATGATCATCACTTTAAGGTGATCCTGCACTATGGCACACTGGTAATCGACGGTGTT
ACGCCGAACATGATCGACTATTTCGGACGGCCGTATGAAGGCATCGCCGTGTTCGACGGCAAAAAGATTACTGTCACT
GGAACCCTGTGGAATGGGAACAAAATTATCGACGAGCGCCTGATCAACCCCGACGGCTCACTGCTGTTCCGAGTAACC
ATCAATGGTGTTACCGGCTGGCGGCTCTGCGAACGCATTCTAGCAAATAGTCACGGCTTTCCGCCTGAGGTTGAAGAG
CAAGCCGCCGGTACATTGCCTATGTCCTGCGCACAAGAAAGCGGTATGGACCGGCACCCAGCCGCTTGTGCTTCAGCT
CGCATCAACGTC

SEQ ID NO: 327 (IL602-L27V03)
ATGAACTCCTTCTCCACAAGCGCCTTCGGTCCAGTCGCCTTCTCCCTGGGCCTGCTCCTGGTGTTGCCCGCTGCCTTT
CCTGCCCCAGTCTTCACACTCGAAGATTTCGTAGGTGACTGGCGACAGACAGCCGGCTACAACCTGGACCAAGTTCTT
GAACAGGGTGGTGTGTCCAGTTTGTTTCAGAATCTCGGGGTGTCCGTAACTCCAATCCAGAGGATAGTCCTGAGTGGT
GAAAATGGGCTGAAGATCGACATCCATGTCATCATCCCTTATGAAGGTCTGAGCGGCGATCAGATGGGGCAGATCGAA
AAAATTTTTAAGGTGGTGTACCCTGTGGATGATCATCACTTTAAGGTGATCCTGCACTATGGCACACTGGTAATCGAC
GGTGTTACGCCGAACATGATCGACTATTTCGGACGGCCGTATGAAGGCATCGCCGTGTTCGACGGCAAAAAGATTACT
GTCACTGGAACCCTGTGGAATGGGAACAAAATTATCGACGAGCGCCTGATCAACCCCGACGGCTCACTGCTGTTCCGA
GTAACCATCAATGGTGTTACCGGCTGG

SEQ ID NO: 328 (Linker)
GSSGGGSSGGEPTTENLYFQSDNGSSGGGSSGG

SEQ ID NO: 329 (FABP Consensus Sequence)
[GSAIVK]-{FE}-[FYW]-x-[LIVMF]-x-x-{K}-x-[NHG]-[FY]-[DE]-x-[LIVMFY]-[LIVM]-
{N}-{G}-[LIVMAKR]

SEQ ID NO: 330 (OGLUC Consensus Sequence)
[GSAIVK]-{FE}-[FYW]-x-[LIVMFSYQ]-x-x-{K}-x-[NHGK]-x-[DE]-x-[LIVMFY]-[LIVMWF]-
x-{G}-[LIVMAKRG]

SEQ ID NO: 331 (9B8 PCA1 (pF5A/Met-[9B8 opt (51-169)]-GGGGSGGGSS-FRB)
Atgggccctgaagatcgacatccatgtcatcatcccgtatgaaggtctgagcggctatcagatgggccagatcgaaaaa
attttaaggtggtgtaccctgtggatgatcatcactttaaggtgattctgcactatggcacactggtaatcgacggg
gttacgccgaacatgatcgactatttcggacggccgtatgaaggcatcgccgtgttcgacgcaaaaagatcactgta
accgggaccctgtggaacggcaacaaaattatcgacgagcgcctgatcaaccccgacggctccctgctgttccgcgta
accatcaacggagtgaccggctggcggctgtgcgagcgcattttggcggaggaggtggctcaggtggagggagctcc

SEQUENCE LISTING gtggccatcctctggcatgagatgtggcatgaaggcctggaagaggcatctcgtttgtactttggggaaaggaacgtg
aaaggcatgtttgaggtgctggagcccttgcatgctatgatggaacggggcccccagactctgaaggaaacatcctttt
aatcaggcctatggtcgagatttaatggaggcccaagagtggtgcaggaagtacatgaaatcagggaatgtcaaggac
ctcacccaagcctgggacctctattatcatgtgttccgacgaatctca SEQ ID NO: 332 (9B8 PCA1 (pF5A/Met-[9B8 opt (51-169)]-GGGGSGGGSS-FRB)
MGLKIDIHVIIPYEGLSGYQMGQIEKIFKVVYPVDDHHFKVILHYGTLVIDGVTPNMIDYFGRPYEGIAVFDGKKITV
TGTLWNGNKIIDERLINPDGSLLFRVTINGVTGWRLCERILAGGGGSGGGSSVAILWHEMWHEGLEEASRLYFGERNV
KGMFEVLEPLHAMMERGPQTLKETSFNQAYGRDLMEAQEWCRKYMKSGNVKDLTQAWDLYYHVFRRIS SEQ ID NO: 333 (9B8 PCA2 (pF5A/[9B8 opt (1-50)]-GGGGSGGGSS-FRB)
Atggtgtttacactcgaagatttcgtaggggactggcggcagacagccggctacaacctggaccaagtccttgagcag
ggcggtctgtccagtttgtttcagaaactcggggtgtccgtaacaccgatccaaaagattgtcctgagcggtgaaaac
ggaggaggtggctcaggtggagggagctccgtggccatcctctggcatgagatgtggcatgaaggcctggaagaggca
tctcgtttgtactttggggaaaggaacgtgaaaggcatgtttgaggtgctggagcccttgcatgctatgatggaacgg
ggcccccagactctgaaggaaacatcctttaatcaggcctatggtcgagatttaatggaggcccaagagtggtgcagg
aagtacatgaaatcagggaatgtcaaggacctcacccaagcctgggacctctattatcatgtgttccgacgaatctca SEQ ID NO: 334 (9B8 PCA2 (pF5A/[9B8 opt (1-50)]-GGGGSGGGSS-FRB)
MVFTLEDFVGDWRQTAGYNLDQVLEQGGLSSLFQKLGVSVTPIQKIVLSGENGGGGSGGGSSVAILWHEMWHEGLEEA
SRLYFGERNVKGMFEVLEPLHAMMERGPQTLKETSFNQAYGRDLMEAQEWCRKYMKSGNVKDLTQAWDLYYHVFRRIS SEQ ID NO: 335 (9B8 PCA 3 (& pF5A/FKBP-GGGSSGGGSG-[9B8 opt (51-169)]
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagcccttttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactgaaggaggagggagctccggtggaggcagcggtggcctgaagatcgacatccatgtcatcatcccgtat
gaaggtctgagcggctatcagatgggccagatcgaaaaaattttttaaggtggtgtacctgtggatgatcatcacttt
aaggtgattctgcactatggcacactggtaatcgacggggttacgccgaacatgatcgactatttcggacggccgtat
gaaggcatcgccgtgttcgacggcaaaaagatcactgtaaccgggaccctgtggaacggcaacaaaattatcgacgag
cgcctgatcaaccccgacggctccctgctgttccgcgtaaccatcaacggagtgaccggctggcggctgtgcgagcgc
attttggcg SEQ ID NO: 336 (9B8 PCA 3 (& pF5A/FKBP-GGGSSGGGSG-[9B8 opt (51-169)]
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGGLKIDIHVIIPYEGLSGYQMGQIEKIFKVVYPVDDHHF
KVILHYGTLVIDGVTPNMIDYFGRPYEGIAVFDGKKITVTGTLWNGNKIIDERLINPDGSLLFRVTINGVTGWRLCER
ILA SEQ ID NO: 337 (9B8 PCA 4 (pF5A/FKBP-GGGSSGGGSG-[9B8 opt (1-50)]
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagcccttttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtgaggcagcggtatgtgtttacactcgaagatttcgtaggggactgg
cggcagacagccggctacaacctggaccaagtccttgagcagggcggtctgtccagtttgtttcagaaactcggggtg
tccgtaacaccgatccaaaagattgtcctgagcggtgaaaac SEQ ID NO: 338 (9B8 PCA 4 (pF5A/FKBP-GGGSSGGGSG-[9B8 opt (1-50)]
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGLSSLFQKLGV
SVTPIQKIVLSGEN SEQ ID NO: 339 (K33N+L27V+K43R+Y68D)
Atggtgtttacactcgaagatttcgtaggggactggcggcagacagccggctacaacctggaccaagtccttgagcag
ggcggtgtgtccagtttgtttcagaatctcggggtgtccgtaacaccgatccaaaagattgtcctgagcggtgaaaac
ggcctgaagatcgacatccatgtcatcatcccgtatgaaggtctgagcggcgatcagatgggccagatcgaaaaaatt
tttaaggtggtgtacctgtggatgatcatcacttttaaggtgattctgcactatggcacactggtaatcgacggggtt
acgccgaacatgatcgactatttcggacggccgtatgaaggcatcgccgtgttcgacggcaaaaagatcactgtaacc
gggaccctgtggaacggcaacaaaattatcgacgagcgcctgatcaaccccgacggctccctgctgttccgcgtaacc
atcaacggagtgaccggctggcggctgtgcgagcgcattttggcg SEQ ID NO: 340 (K33N+L27V+K43R+Y68D)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILA SEQ ID NO: 341 (K33N+ L27V+T39T+K43R+S66N)
Atggtgtttacactcgaagatttcgtaggggactggcggcagacagccggctacaacctggaccaagtccttgagcag
ggcggtgtgtccagtttgtttcagaatctcggggtgtccgtaactccgatccaaaagattgtcctgagcggtgaaaac
ggcctgaagatcgacatccatgtcatcatcccgtatgaaggtctgagcggcgatcagatgggccagatcgaaaaaatt
tttaaggtggtgtacctgtggatgatcatcacttttaaggtgattctgcactatggcacactggtaatcgacggggtt
acgccgaacatgatcgactatttcggacggccgtatgaaggcatcgccgtgttcgacggcaaaaagatcactgtaacc
gggaccctgtggaacggcaacaaaattatcgacgagcgcctgatcaaccccgacggctccctgctgttccgcgtaacc
atcaacggagtgaccggctggcggctgtgcgagcgcattttggcg

SEQUENCE LISTING

SEQ ID NO: 342 (K33N+ L27V+T39T+K43R+S66N)
MVFTLEDFVGDWRQTAGYNLDQVLEQGGVSSLFQNLGVSVTPIQRIVLSGENGLKIDIHVIIPYEGLNGYQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILA

SEQ ID NO: 343 (pCA 31 pCA L27V02A 45-169 FRB)
atggtcctgagcggtgaaaatgggctgaagatcgacatccatgtcatcatcccgtatgaaggtctgagcggcgaccaa
atgggccagatcgaaaaaattttttaaggtggtgtaccctgtggatgatcatcactttaaggtgatcctgcactatggc
acactggtaatcgacggggttacgccgaacatgatcgactatttcggacggccgtatgaaggcatcgccgtgttcgac
ggcaaaaagatcactgtaacagggaccctgtggaacggcaacaaaattatcgacgagcgcctgatcaaccccgacggc
tccctgctgttccgagtaaccatcaacggagtgaccggctggcggctgtgcgaacgcattctggcgggaggaggtggc
tcaggtggagggagctccgtggccatcctctggcatgagatgtggcatgaaggcctggaagaggcatctcgtttgtac
tttggggaaggaacgtgaaaggcatgtttgaggtgctggagcccttgcatgctatgatggaacggggccccagact
ctgaaggaaacatcctttaatcaggcctatggtcgagatttaatggaggcccaagagtggtgcaggaagtacatgaaa
tcagggaatgtcaaggacctcacccaagcctgggacctctattatcatgtgttccgacgaatctca SEQ ID NO: 344 (pCA 31 pCA L27V02A 45-169 FRB)
MVLSGENGLKIDIHVIIPYEGLSGDQMGQIEKIFKVVYPVDDHHFKVILHYGTLVIDGVTPNMIDYFGRPYEGIAVFD
GKKITVTGTLWNGNKIIDERLINPDGSLLFRVTINGVTGWRLCERILAGGGGSGGGGSSVAILWHEMWHEGLEEASRLY
FGERNVKGMFEVLEPLHAMMERGPQTLKETSFNQAYGRDLMEAQEWCRKYMKSGNVKDLTQAWDLYYHVFRRIS SEQ ID NO: 345 (pCA 32 FKBP L27V02A 1-44)
atgggagtgcaggtggaaaccatctccccaggagacgggcgcaccttccccaagcgcggccagacctgcgtggtgcac
tacaccgggatgcttgaagatggaaagaaatttgattcctccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggatt SEQ ID NO: 346 (pCA 32 FKBP L27V02A 1-44)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGGSGMVFTLEDFVGDWRQTAGYNLDQVLEQGGVSSLFQNLGV
SVTPIQRI SEQ ID NO: 347 (pCA 33 pCA L27V02A 46-169 FRB)
atgctgagcggtgaaaatgggctgaagatcgacatccatgtcatcatcccgtatgaaggtctgagcggcgaccaaatg
ggccagatcgaaaaaattttttaaggtggtgtaccctgtggatgatcatcactttaaggtgatcctgcactatggcaca
ctggtaatcgacggggttacgccgaacatgatcgactatttcggacggccgtatgaaggcatcgccgtgttcgacggc
aaaaagatcactgtaacagggaccctgtggaacggcaacaaaattatcgacgagcgcctgatcaaccccgacggctcc
ctgctgttccgagtaaccatcaacggagtgaccggctggcggctgtgcgaacgcattctggcgggaggaggtggctc
ggtggagggagctccgtggccatcctctggcatgagatgtggcatgaaggcctggaagaggcatctcgtttgtacttt
ggggaaggaacgtgaaaggcatgtttgaggtgctggagcccttgcatgctatgatggaacggggccccagactctg
aaggaaacatcctttaatcaggcctatggtcgagatttaatggaggcccaagagtggtgcaggaagtacatgaaatca
gggaatgtcaaggacctcacccaagcctgggacctctattatcatgtgttccgacgaatctca SEQ ID NO: 348 (pCA 33 pCA L27V02A 46-169 FRB)
MLSGENGLKIDIHVIIPYEGLSGDQMGQIEKIFKVVYPVDDHHFKVILHYGTLVIDGVTPNMIDYFGRPYEGIAVFDG
KKITVTGTLWNGNKIIDERLINPDGSLLFRVTINGVTGWRLCERILAGGGGSGGGGSSVAILWHEMWHEGLEEASRLYF
GERNVKGMFEVLEPLHAMMERGPQTLKETSFNQAYGRDLMEAQEWCRKYMKSGNVKDLTQAWDLYYHVFRRIS SEQ ID NO: 349 (pCA 34 pCA FKBP 1-45 L27V02A)
atgggagtgcaggtggaaaccatctccccaggagacgggcgcaccttccccaagcgcggccagacctgcgtggtgcac
tacaccgggatgcttgaagatggaaagaaatttgattcctccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtc SEQ ID NO: 350 (pCA 34 pCA FKBP 1-45 L27V02A)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGGSGMVFTLEDFVGDWRQTAGYNLDQVLEQGGVSSLFQNLGV
SVTPIQRIV SEQ ID NO: 351 (pCA 35 pCA L27V02A 100-169 FRB)
atggacggggttacgccgaacatgatcgactatttcggacggccgtatgaaggcatcgccgtgttcgacggcaaaaag
atcactgtaacagggaccctgtggaacggcaacaaaattatcgacgagcgcctgatcaaccccgacggctccctgctg
ttccgagtaaccatcaacggagtgaccggctggcggctgtgcgaacgcattctggcgggaggaggtggctcaggtgga
gggagctccgtggccatcctctggcatgagatgtggcatgaaggcctggaagaggcatctcgtttgtactttggggaa
aggaacgtgaaaggcatgtttgaggtgctggagcccttgcatgctatgatggaacggggccccagactctgaaggaa
acatcctttaatcaggcctatggtcgagatttaatggaggcccaagagtggtgcaggaagtacatgaaatcagggaat
gtcaaggacctcacccaagcctgggacctctattatcatgtgttccgacgaatctca

SEQUENCE LISTING

SEQ ID NO: 352 (pCA 35 pCA L27V02A 100-169 FRB)
MDGVTPNMIDYFGRPYEGIAVFDGKKITVTGTLWNGNKIIDERLINPDGSLLFRVTINGVTGWRLCERILAGGGGSGG
GSSVAILWHEMWHEGLEEASRLYFGERNVKGMFEVLEPLHAMMERGPQTLKETSFNQAYGRDLMEAQEWCRKYMKSGN
VKDLTQAWDLYYHVFRRIS

SEQ ID NO: 353 (pCA 36 FKBP L27V02A 1-99)
atggggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaatttttaaggtggtgtaccctgtggatgatcatcactttt
aaggtgatcctgcactatggcacactggtaatc SEQ ID NO: 354 (pCA 36 FKBP L27V02A 1-99)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVI SEQ ID NO: 355 (pCA 37 L27V02A 101-169 FRB)
atggggttacgccgaacatgatcgactatttcggacggccgtatgaaggcatcgccgtgttcgacggcaaaaagatc
actgtaacagggaccctgtggaacggcaacaaaattatcgacgagcgcctgatcaaccccgacggctccctgctgttc
cgagtaaccatcaacggagtgaccggctggcggctgtgcgaacgcattctggcgggaggaggtggctcaggtggaggg
agctccgtggccatcctctggcatgagatgtggcatgaaggcctggaagaggcatctcgtttgtactttggggaaagg
aacgtgaaaggcatgtttgaggtgctggagccctttgcatgctatggtggaacggggcccccagactctgaaggaaaca
tcctttaatcaggcctatggtcgagatttaatggaggcccaagagtggtgcaggaagtacatgaaatcagggaatgtc
aaggacctcacccaagcctgggacctctattatcatgtgttccgacgaatctca SEQ ID NO: 356 (pCA 37 L27V02A 101-169 FRB)
MGVTPNMIDYFGRPYEGIAVFDGKKITVTGTLWNGNKIIDERLINPDGSLLFRVTINGVTGWRLCERILAGGGGSGGG
SSVAILWHEMWHEGLEEASRLYFGERNVKGMFEVLEPLHAMMERGPQTLKETSFNQAYGRDLMEAQEWCRKYMKSGNV
KDLTQAWDLYYHVFRRIS SEQ ID NO: 357 (pCA 38 FKBP 1-100 L27V02A)
Atggggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaatttttaaggtggtgtaccctgtggatgatcatcactttt
aaggtgatcctgcactatggcacactggtaatcgac SEQ ID NO: 358 (pCA 38 FKBP 1-100 L27V02A)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVID SEQ ID NO: 359 (pCA 39 L27V02A 102-169 FRB)
Atggttacgccgaacatgatcgactatttcggacggccgtatgaaggcatcgccgtgttcgacggcaaaaagatcact
gtaacagggaccctgtggaacggcaacaaaattatcgacgagcgcctgatcaaccccgacggctccctgctgttccga
gtaaccatcaacggagtgaccggctggcggctgtgcgaacgcattctggcgggaggaggtggctcaggtggagggagc
tccgtggccatcctctggcatgagatgtggcatgaaggcctggaagaggcatctcgtttgtactttggggaaaggaac
gtgaaaggcatgtttgaggtgctggagccctttgcatgctatgatggaacggggcccccagactctgaaggaaacatcc
tttaatcaggcctatggtcgagatttaatggaggcccaagagtggtgcaggaagtacatgaaatcagggaatgtcaag
gacctcacccaagcctgggacctctattatcatgtgttccgacgaatctca SEQ ID NO: 360 (pCA 39 L27V02A 102-169 FRB)
MVTPNMIDYFGRPYEGIAVFDGKKITVTGTLWNGNKIIDERLINPDGSLLFRVTINGVTGWRLCERILAGGGGSGGGS
SVAILWHEMWHEGLEEASRLYFGERNVKGMFEVLEPLHAMMERGPQTLKETSFNQAYGRDLMEAQEWCRKYMKSGNVK
DLTQAWDLYYHVFRRIS SEQ ID NO: 361 (pCA 40 FKBP L27V02A 1-101)
atggggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaatttttaaggtggtgtaccctgtggatgatcatcactttt
aaggtgatcctgcactatggcacactggtaatcgacggg

SEQUENCE LISTING

SEQ ID NO: 362 (pCA 40 FKBP L27V02A 1-101)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDG

SEQ ID NO: 363 (pCA 41 L27V02A 143-169 FRB)
atgatcaaccccgacggctccctgctgttccgagtaaccatcaacggagtgaccggctggcggctgtgcgaacgcatt
ctggcggggaggaggtggctcaggtggagggagctccgtggccatcctctggcatgagatgtggcatgaaggcctggaa
gaggcatctcgtttgtactttggggaaaggaacgtgaaaggcatgtttgaggtgctggagcccttgcatgctatgatg
gaacggggcccccagactctgaaggaaacatcctttaatcaggcctatggtcgagatttaatggaggcccaagagtgg
tgcaggaagtacatgaaatcagggaatgtcaaggacctcacccaagcctgggacctctattatcatgtgttccgacga
atctca SEQ ID NO: 364 (pCA 41 L27V02A 143-169 FRB)
MINPDGSLLFRVTINGVTGWRLCERILAGGGGSGGGSSVAILWHEMWHEGLEEASRLYFGERNVKGMFEVLEPLHAMM
ERGPQTLKETSFNQAYGRDLMEAQEWCRKYMKSGNVKDLTQAWDLYYHVFRRIS SEQ ID NO: 365 (pCA 42 FKBP 1-142 L27V02A)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagcccttttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggaggaggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttaaggtggtgtaccctgtggatgatcatcactttt
aaggtgatcctgcactatggcacactggtaatcgacggggttacgccgaacatgatcgactatttcggacggccgtat
gaaggcatcgccgtgttcgacggcaaaaagatcactgtaacagggaccctgtggaacggcaacaaaattatcgacgag
cgcctg SEQ ID NO: 366 (pCA 42 FKBP 1-142 L27V02A)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERL SEQ ID NO: 367 (pCA 43 L27V02A 145-169 FRB)
atgcccgacggctccctgctgttccgagtaaccatcaacggagtgaccggctggcggctgtgcgaacgcattctggcg
ggaggaggtggctcaggtggagggagctccgtggccatcctctggcatgagatgtggcatgaaggcctggaagaggca
tctcgtttgtactttggggaaaggaacgtgaaaggcatgtttgaggtgctggagcccttgcatgctatgatggaacgg
ggcccccagactctgaaggaaacatcctttaatcaggcctatggtcgagatttaatggaggcccaagagtggtgcagg
aagtacatgaaatcagggaatgtcaaggacctcacccaagcctgggacctctattatcatgtgttccgacgaatctca SEQ ID NO: 368 (pCA 43 L27V02A 145-169 FRB)
MPDGSLLFRVTINGVTGWRLCERILAGGGGSGGGSSVAILWHEMWHEGLEEASRLYFGERNVKGMFEVLEPLHAMMER
GPQTLKETSFNQAYGRDLMEAQEWCRKYMKSGNVKDLTQAWDLYYHVFRRIS SEQ ID NO: 369 (pCA 44 FKBP 1-144 L27V02A)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagcccttttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggaggaggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttaaggtggtgtaccctgtggatgatcatcactttt
aaggtgatcctgcactatggcacactggtaatcgacggggttacgccgaacatgatcgactatttcggacggccgtat
gaaggcatcgccgtgttcgacggcaaaaagatcactgtaacagggaccctgtggaacggcaacaaaattatcgacgag
cgcctgatcaac SEQ ID NO: 370 (pCA 44 FKBP 1-144 L27V02A)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERLIN SEQ ID NO: 371 (pCA 45 L27V02A 147-169 FRB)
atgggctccctgctgttccgagtaaccatcaacggagtgaccggctggcggctgtgcgaacgcattctggcggggagga
ggtggctcaggtggagggagctccgtggccatcctctggcatgagatgtggcatgaaggcctggaagaggcatctcgt
ttgtactttggggaaaggaacgtgaaaggcatgtttgaggtgctggagcccttgcatgctatgatggaacggggcccc
cagactctgaaggaaacatcctttaatcaggcctatggtcgagatttaatggaggcccaagagtggtgcaggaagtac
atgaaatcagggaatgtcaaggacctcacccaagcctgggacctctattatcatgtgttccgacgaatctca SEQ ID NO: 372 (pCA 45 L27V02A 147-169 FRB)
MGSLLFRVTINGVTGWRLCERILAGGGGSGGGSSVAILWHEMWHEGLEEASRLYFGERNVKGMFEVLEPLHAMMERGP
QTLKETSFNQAYGRDLMEAQEWCRKYMKSGNVKDLTQAWDLYYHVFRRIS

SEQUENCE LISTING

SEQ ID NO: 373 (pCA 46 FKBP-L27V02A 1-146)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagcactttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttaaggtggtgtaccctgtggatgatcatcacttt
aaggtgatcctgcactatggcacactggtaatcgacggggttacgccgaacatgatcgactatttcggacggccgtat
gaaggcatcgccgtgttcgacggcaaaaagatcactgtaacaggacccctgtggaacggcaacaaaattatcgacgag
cgcctgatcaaccccgac SEQ ID NO: 374 (pCA 46 L27V02A-FKBP 1-146)
MGVQVETISPGDGRTFPKRGQTCVVHYTGMLEDGKKFDSSRDRNKHFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERLINPD SEQ ID NO: 375 (pCA 47 L27V02A 148-169 FRB)
atgtccctgctgttccgagtaaccatcaacgagtgaccggctggcggctgtgcgaacgcattctggcgggaggaggt
ggctcaggtggaggagctccgtggccatcctctggcatgagatgtggcatgaaggcctggaagaggcatctcgtttg
tactttggggaaaggaacgtgaaaggcatgtttgaggtgctggagcccttgcatgctatgatggaacggggcccccag
actctgaaggaaacatcctttaatcaggcctatggtcgagatttaatggagcccaagagtggtgcaggaagtacatg
aaatcagggaatgtcaaggacctcacccaagcctgggacctctattatcatgtgttccgacgaatctca SEQ ID NO: 376 (pCA 47 L27V02A 148-169 FRB)
MSLLFRVTINGVTGWRLCERILAGGGSGGGSSVAILWHEMWHEGLEEASRLYFGERNVKGMFEVLEPLHAMMERGPQ
TLKETSFNQAYGRDLMEAQEWCRKYMKSGNVKDLTQAWDLYYHVFRRIS SEQ ID NO: 377 (pCA 48 FKBP-L27V02A 1-147)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttaaggtggtgtaccctgtggatgatcatcacttt
aaggtgatcctgcactatggcacactggtaatcgacggggttacgccgaacatgatcgactatttcggacggccgtat
gaaggcatcgccgtgttcgacggcaaaaagatcactgtaacaggacccctgtggaacggcaacaaaattatcgacgag
cgcctgatcaaccccgacggc SEQ ID NO: 378 (pCA 48 FKBP-L27V02A 1-147)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERLINPDG SEQ ID NO: 379 (pCA 49 L27V02A 156-169 FRB)
atgaacggagtgaccggctggcggctgtgcgaacgcattctggcgggaggaggtggctcaggtggaggagctccgtg
gccatcctctggcatgagatgtggcatgaaggcctggaagaggcatctcgtttgtactttggggaaaggaacgtgaaa
ggcatgtttgaggtgctggagcccttgcatgctatgatggaacggggcccccagactctgaaggaaacatcctttaat
caggcctatggtcgagatttaatggagcccaagagtggtgcaggaagtacatgaaatcagggaatgtcaaggacctc
acccaagcctgggacctctattatcatgtgttccgacgaatctca SEQ ID NO: 380 (pCA 49 L27V02A 156-169 FRB)
MNGVTGWRLCERILAGGGSGGGSSVAILWHEMWHEGLEEASRLYFGERNVKGMFEVLEPLHAMMERGPQTLKETSFN
QAYGRDLMEAQEWCRKYMKSGNVKDLTQAWDLYYHVFRRIS SEQ ID NO: 381 (pCA 50 FKBP-L27V02A 1-155)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttaaggtggtgtaccctgtggatgatcatcacttt
aaggtgatcctgcactatggcacactggtaatcgacggggttacgccgaacatgatcgactatttcggacggccgtat
gaaggcatcgccgtgttcgacggcaaaaagatcactgtaacaggacccctgtggaacggcaacaaaattatcgacgag
cgcctgatcaaccccgacggctccctgctgttccgagtaaccatc SEQ ID NO: 382 (pCA 50 FKBP-L27V02A 1-155)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV

SEQUENCE LISTING

SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERLINPDGSLLFRVTI

SEQ ID NO: 383 (pCA 51 L27V02A 158-169 FRB)
atggtgaccggctggcggctgtgcgaacgcattctggcggggaggaggtggctcaggtggagggagctccgtggccatc
ctctggcatgagatgtggcatgaaggcctggaagaggcatctcgtttgtactttggggaaaggaacgtgaaaggcatg
tttgaggtgctggagcccttgcatgctatgatggaacgggcccccagactctgaaggaaacatcctttaatcaggcc
tatggtcgagatttaatggaggcccaagagtggtgcaggaagtacatgaaatcagggaatgtcaaggacctcacccaa
gcctgggacctctattatcatgtgttccgacgaatctca SEQ ID NO: 384 (pCA 51 L27V02A 158-169 FRB)
MVTGWRLCERILAGGGGSGGGSSVAILWHEMWHEGLEEASRLYFGERNVKGMFEVLEPLHAMMERGPQTLKETSFNQA
YGRDLMEAQEWCRKYMKSGNVKDLTQAWDLYYHVFRRIS SEQ ID NO: 385 (pCA 52 FKBP 1-157 L27V02A)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagcccttaagtttatgctaggc
aagcaggaggtgatccgaggctggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttaaggtggtgtaccctgtggatgatcatcactttt
aaggtgatcctgcactatggcacactggtaatcgacggggttacgccgaacatgatcgactatttcggacggccgtat
gaaggcatcgccgtgttcgacggcaaaaagatcactgtaacaggaccctgtggaacggcaacaaaattatcgacgag
cgcctgatcaacccgacggctccctgctgttccgagtaaccatcaacgga SEQ ID NO: 386 (pCA 52 FKBP 1-157 L27V02A)
MGVQVETISPGDGRTFPKRGQTCVVHYTGMLEDGKKFDSSRDRNKPFKMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERLINPDGSLLFRVTING SEQ ID NO: 387 (pCA 53 L27V02A 166-169 FRB)
atgcgcattctggcggggaggaggtggctcaggtggagggagctccgtggccatcctctggcatgagatgtggcatgaa
ggcctggaagaggcatctcgtttgtactttggggaaaggaacgtgaaaggcatgtttgaggtgctggagcccttgcat
gctatgatggaacgggcccccagactctgaaggaaacatcctttaatcaggcctatggtcgagatttaatggaggcc
caagagtggtgcaggaagtacatgaaatcagggaatgtcaaggacctcacccaagcctgggacctctattatcatgtg
ttccgacgaatctca SEQ ID NO: 388 (pCA 53 L27V02A 166-169 FRB)
MRILAGGGGSGGGSSVAILWHEMWHEGLEEASRLYFGERNVKGMFEVLEPLHAMMERGPQTLKETSFNQAYGRDLMEA
QEWCRKYMKSGNVKDLTQAWDLYYHVFRRIS SEQ ID NO: 389 (pCA 54 FKBP L27V02A 1-165)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagcccttaagtttatgctaggc
aagcaggaggtgatccgaggctggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttaaggtggtgtaccctgtggatgatcatcactttt
aaggtgatcctgcactatggcacactggtaatcgacggggttacgccgaacatgatcgactatttcggacggccgtat
gaaggcatcgccgtgttcgacggcaaaaagatcactgtaacaggaccctgtggaacggcaacaaaattatcgacgag
cgcctgatcaacccgacggctccctgctgttccgagtaaccatcaacggagtgaccggctggcggctgtgcgaa SEQ ID NO: 390 (pCA 54 FKBP L27V02A 1-165)
MGVQVETISPGDGRTFPKRGQTCVVHYTGMLEDGKKFDSSRDRNKPFKMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERLINPDGSLLFRVTINGVTGWRLCE SEQ ID NO: 391 (pCA 55 FKBP L27V02A 1-47)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagcccttaagtttatgctaggc
aagcaggaggtgatccgaggctggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagc SEQ ID NO: 392 (pCA 55 FKBP L27V02A 1-47)
MGVQVETISPGDGRTFPKRGQTCVVHYTGMLEDGKKFDSSRDRNKPFKMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLS

SEQUENCE LISTING

SEQ ID NO: 393 (pCA 56 L27V02A 48-169-FRB)
Atgggtgaaaatgggctgaagatcgacatccatgtcatcatcccgtatgaaggtctgagcggcgaccaaatgggccag
atcgaaaaaattttttaaggtggtgtaccctgtggatgatcatcactttaaggtgatcctgcactatggcacactggta
atcgacggggttacgccgaacatgatcgactatttcggacggccgtatgaaggcatcgccgtgttcgacggcaaaaag
atcactgtaacagggaccctgtggaacggcaacaaaattatcgacgagcgcctgatcaaccccgacggctccctgctg
ttccgagtaaccatcaacggagtgaccggctggcggctgtgcgaacgcattctggcgggaggaggtggctcaggtgga
gggagctccgtggccatcctctggcatgagatgtggcatgaaggcctggaagaggcatctcgtttgtactttggggaa
aggaacgtgaaaggcatgtttgaggtgctggagcccttgcatgctatgatggaacggggcccccagactctgaaggaa
acatcctttaatcaggcctatggtcgagatttaatggaggcccaagagtggtgcaggaagtacatgaaatcagggaat
gtcaaggacctcacccaagcctgggacctctattatcatgtgttccgacgaatctca SEQ ID NO: 394 (pCA 56 L27V02A 48-169-FRB)
MGENGLKIDIHVIIPYEGLSGDQMGQIEKIFKVVYPVDDHHFKVILHYGTLVIDGVTPNMIDYFGRPYEGIAVFDGKK
ITVTGTLWNGNKIIDERLINPDGSLLFRVTINGVTGWRLCERILAGGGGSGGGSSVAILWHEMWHEGLEEASRLYFGE
RNVKGMFEVLEPLHAMMERGPQTLKETSFNQAYGRDLMEAQEWCRKYMKSGNVKDLTQAWDLYYHVFRRIS SEQ ID NO: 395 (pCA 57 FKBP L27V02A 1-49)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagcccttttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaa SEQ ID NO: 396 (pCA 57 FKBP L27V02A 1-49)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSGGGSGMVFTLEDFVGDWRQTAGYNLDQVLEQGGVSSLFQNLGV
SVTPIQRIVLSGE SEQ ID NO: 397 (pCA 58 pCA L27V02A 50-169 FRB)
atgaatgggctgaagatcgacatccatgtcatcatcccgtatgaaggtctgagcggcgaccaaatgggccagatcgaa
aaaattttttaaggtggtgtaccctgtggatgatcatcactttaaggtgatcctgcactatggcacactggtaatcgac
ggggttacgccgaacatgatcgactatttcggacggccgtatgaaggcatcgccgtgttcgacggcaaaaagatcact
gtaacagggaccctgtggaacggcaacaaaattatcgacgagcgcctgatcaaccccgacggctccctgctgttccga
gtaaccatcaacggagtgaccggctggcggctgtgcgaacgcattctggcgggaggaggtggctcaggtggagggagc
tccgtggccatcctctggcatgagatgtggcatgaaggcctggaagaggcatctcgtttgtactttggggaaaggaac
gtgaaaggcatgtttgaggtgctggagcccttgcatgctatgatggaacggggcccccagactctgaaggaaacatcc
tttaatcaggcctatggtcgagatttaatggaggcccaagagtggtgcaggaagtacatgaaatcagggaatgtcaag
gacctcacccaagcctgggacctctattatcatgtgttccgacgaatctca SEQ ID NO: 398 (pCA 58 pCA L27V02A 50-169 FRB)
MNGLKIDIHVIIPYEGLSGDQMGQIEKIFKVVYPVDDHHFKVILHYGTLVIDGVTPNMIDYFGRPYEGIAVFDGKKIT
VTGTLWNGNKIIDERLINPDGSLLFRVTINGVTGWRLCERILAGGGGSGGGSSVAILWHEMWHEGLEEASRLYFGERN
VKGMFEVLEPLHAMMERGPQTLKETSFNQAYGRDLMEAQEWCRKYMKSGNVKDLTQAWDLYYHVFRRIS SEQ ID NO: 399 (pCA 59 FKBP L27V02A 1-82)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagcccttttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaatgggctgaagatcgacatccatgtcatcatcccgtat
gaaggtctgagcggcgaccaaatgggccagatcgaaaaaattttttaaggtggtgtaccct SEQ ID NO: 400 (pCA 59 FKBP L27V02A 1-82)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSGGGSGMVFTLEDFVGDWRQTAGYNLDQVLEQGGVSSLFQNLGV
SVTPIQRIVLSGENGLKIDIHVIIPYEGLSGDQMGQIEKIFKVVYP SEQ ID NO: 401 (pCA 60 L27V02A 83-169-FRB)
atggtggatgatcatcactttaaggtgatcctgcactatggcacactggtaatcgacggggttacgccgaacatgatc
gactatttcggacggccgtatgaaggcatcgccgtgttcgacggcaaaaagatcactgtaacagggaccctgtggaac
ggcaacaaaattatcgacgagcgcctgatcaaccccgacggctccctgctgttccgagtaaccatcaacggagtgacc
ggctggcggctgtgcgaacgcattctggcgggaggaggtggctcaggtggagggagctccgtggccatcctctggcat
gagatgtggcatgaaggcctggaagaggcatctcgtttgtactttggggaaaggaacgtgaaaggcatgtttgaggtg
ctggagcccttgcatgctatgatggaacggggcccccagactctgaaggaaacatcctttaatcaggcctatggtcga
gatttaatggaggcccaagagtggtgcaggaagtacatgaaatcagggaatgtcaaggacctcacccaagcctgggac
ctctattatcatgtgttccgacgaatctca SEQ ID NO: 402 (pCA 60 L27V02A 83-16-FRB)
MVDDHHFKVILHYGTLVIDGVTPNMIDYFGRPYEGIAVFDGKKITVTGTLWNGNKIIDERLINPDGSLLFRVTINGVT
GWRLCERILAGGGGSGGGSSVAILWHEMWHEGLEEASRLYFGERNVKGMFEVLEPLHAMMERGPQTLKETSFNQAYGR
DLMEAQEWCRKYMKSGNVKDLTQAWDLYYHVFRRIS SEQ ID NO: 403 (pCA 61 FKBP L27V02A 1-84)
Atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttttaaggtggtgtaccctgtggat SEQ ID NO: 404 (pCA 61 FKBP L27V02A 1-84)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVD SEQ ID NO: 405 (pCA 62 L27V02A 85-169-FRB)
atggatcatcactttaaggtgatcctgcactatggcacactggtaatcgacggggttacgccgaacatgatcgactat
ttcggacggccgtatgaaggcatcgccgtgttcgacggcaaaaagatcactgtaacagggaccctgtggaacggcaac
aaaattatcgacgagcgcctgatcaaccccgacggctccctgctgttccgagtaaccatcaacggagtgaccggctgg
cggctgtgcgaacgcattctggcggggaggaggtggctcaggtggagggagctccgtggccatcctctggcatgagatg
tggcatgaaggcctggaagaggcatctcgtttgtactttggggaaaggaacgtgaaaggcatgtttgaggtgctggag
cccttgcatgctatgatggaacggggcccccagactctgaaggaaacatcctttaatcaggcctatggtcgagatta
atggaggcccaagagtggtgcaggaagtacatgaaatcagggaatgtcaaggacctcacccaagcctgggacctctat
tatcatgtgttccgacgaatctca SEQ ID NO: 406 (pCA 62 L27V02A 85-169-FRB)
MDHHFKVILHYGTLVIDGVTPNMIDYFGRPYEGIAVFDGKKITVTGTLWNGNKIIDERLINPDGSLLFRVTINGVTGW
RLCERILAGGGGSGGGSSVAILWHEMWHEGLEEASRLYFGERNVKGMFEVLEPLHAMMERGPQTLKETSFNQAYGRDL
MEAQEWCRKYMKSGNVKDLTQAWDLYYHVFRRIS SEQ ID NO: 407 (pCA 63 FKBP L27V02A 1-122)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttttaaggtggtgtaccctgtggatgatcatcacttt
aaggtgatcctgcactatggcacactggtaatcgacggggttacgccgaacatgatcgactatttcggacggccgtat
gaaggcatcgccgtgttcgacggc SEQ ID NO: 408 (pCA 63 FKBP L27V02A 1-122)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDG SEQ ID NO: 409 (pCA 64 L27V02A 123-169-FRB)
atgaaaaagatcactgtaacagggaccctgtggaacggcaacaaaattatcgacgagcgcctgatcaaccccgacggc
tccctgctgttccgagtaaccatcaacggagtgaccggctggcggctgtgcgaacgcattctggcgggaggaggtggc
tcaggtggagggagctccgtggccatcctctggcatgagatgtggcatgaaggcctggaagaggcatctcgtttgtac
tttggggaaaggaacgtgaaaggcatgtttgaggtgctggagcccttgcatgctatgatggaacggggcccccagact
ctgaaggaaacatcctttaatcaggcctatggtcgagatttaatggaggcccaagagtggtgcaggaagtacatgaaa
tcagggaatgtcaaggacctcacccaagcctgggacctctattatcatgtgttccgacgaatctca SEQ ID NO: 410 (pCA 64 L27V02A 123-169-FRB)
MKKITVTGTLWNGNKIIDERLINPDGSLLFRVTINGVTGWRLCERILAGGGGSGGGSSVAILWHEMWHEGLEEASRLY
FGERNVKGMFEVLEPLHAMMERGPQTLKETSFNQAYGRDLMEAQEWCRKYMKSGNVKDLTQAWDLYYHVFRRIS SEQ ID NO: 411 (pCA 65 FKBP L27V02A 1-123)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttttaaggtggtgtaccctgtggatgatcatcacttt
aaggtgatcctgcactatggcacactggtaatcgacggggttacgccgaacatgatcgactatttcggacggccgtat
gaaggcatcgccgtgttcgacggcaaa SEQ ID NO: 412 (pCA 65 FKBP L27V02A 1-123)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV -continued

SEQUENCE LISTING

SVTPIQRIVLSGENGLKIDIHVIIPYEGLSGDQMGQIEKIFKVVYPVDDHHFKVILHYGTLVIDGVTPNMIDYFGRPY
EGIAVFDGK

SEQ ID NO: 413 (pCA 66 L27V02A 124-169 FRB)
atgaagatcactgtaacagggaccctgtggaacggcaacaaaattatcgacgagcgcctgatcaaccccgacggctcc
ctgctgttccgagtaaccatcaacggagtgaccggctggcggctgtgcgaacgcattctggcgggaggaggtggctca
ggtggagggagctccgtggccatcctctggcatgagatgtggcatgaaggcctggaagaggcatctcgtttgtacttt
ggggaaaggaacgtgaaaggcatgtttgaggtgctggagcccttgcatgctatgatggaacgggccccagactctg
aaggaaacatcctttaatcaggcctatggtcgagatttaatggaggcccaagagtggtgcaggaagtacatgaaatca
gggaatgtcaaggacctcacccaagcctgggacctctattatcatgtgttccgacgaatctca SEQ ID NO: 414 (pCA 66 L27V02A 124-169 FRB)
MKITVTGTLWNGNKIIDERLINPDGSLLFRVTINGVTGWRLCERILAGGGGSGGGSSVAILWHEMWHEGLEEASRLYF
GERNVKGMFEVLEPLHAMMERGPQTLKETSFNQAYGRDLMEAQEWCRKYMKSGNVKDLTQAWDLYYHVFRRIS SEQ ID NO: 415 (pCA 67 L27V02A 1-168)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaatttttaaggtggtgtaccctgtggatgatcatcacttt
aaggtgatcctgcactatggcacactggtaatcgacggggttacgccgaacatgatcgactatttcggacggccgtat
gaaggcatcgccgtgttcgacggcaaaaagatcactgtaacagggaccctgtggaacggcaacaaaattatcgacgag
cgcctgatcaaccccgacggctccctgctgttccgagtaaccatcaacggagtgaccggctggcggctgtgcgaacgc
attctg SEQ ID NO: 416 (pCA 67 L27V02A 1-168)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaatttttaaggtggtgtaccctgtggatgatcatcacttt
aaggtgatcctgcactatggcacactggtaatcgacggggttacgccgaacatgatcgactatttcggacggccgtat
gaaggcatcgccgtgttcgacggcaaaaagatcactgtaacagggaccctgtggaacggcaacaaaattatcgacgag
cgcctgatcaaccccgacggctccctgctgttccgagtaaccatcaacggagtgaccggctggcggctgtgcgaacgc
attctg SEQ ID NO: 417 (pCA 67 L27V02A 1-168)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERLINPDGSLLFRVTINGVTGWRLCERIL SEQ ID NO: 418 (*pCA 68 L27V02A 169 FRB)
Atggcgggaggaggtggctcaggtggagggagctccgtggccatcctctggcatgagatgtggcatgaaggcctggaa
gaggcatctcgtttgtactttggggaaaggaacgtgaaaggcatgtttgaggtgctggagcccttgcatgctatgatg
gaacgggccccagactctgaaggaaacatcctttaatcaggcctatggtcgagatttaatggaggcccaagagtgg
tgcaggaagtacatgaaatcagggaatgtcaaggacctcacccaagcctgggacctctattatcatgtgttccgacga
atctca SEQ ID NO: 419 (*pCA 68 L27V02A 169 FRB)
MAGGGGSGGGSSVAILWHEMWHEGLEEASRLYFGERNVKGMFEVLEPLHAMMERGPQTLKETSFNQAYGRDLMEAQEW
CRKYMKSGNVKDLTQAWDLYYHVFRRIS SEQ ID NO: 420 (pCA 69 FKBP L27V02A 1-166)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaatttttaaggtggtgtaccctgtggatgatcatcacttt
aaggtgatcctgcactatggcacactggtaatcgacggggttacgccgaacatgatcgactatttcggacggccgtat
gaaggcatcgccgtgttcgacggcaaaaagatcactgtaacagggaccctgtggaacggcaacaaaattatcgacgag
cgcctgatcaaccccgacggctccctgctgttccgagtaaccatcaacggagtgaccggctggcggctgtgcgaacgc

SEQUENCE LISTING

SEQ ID NO: 421 (pCA 69 FKBP L27V02A 1-166)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERLINPDGSLLFRVTINGVTGWRLCER

SEQ ID NO: 422 (*pCA 70 L27V02A 167-169 FRB)
Atgattctggcgggaggaggtggctcaggtggagggagctccgtggccatcctctggcatgagatgtggcatgaaggc
ctggaagaggcatctcgtttgtactttggggaaaggaacgtgaaaggcatgtttgaggtgctggagcccttgcatgct
atgatggaacggggcccccagactctgaaggaaacatcctttaatcaggcctatggtcgagatttaatggaggcccaa
gagtggtgcaggaagtacatgaaatcagggaatgtcaaggacctcacccaagcctgggacctctattatcatgtgttc
cgacgaatctca SEQ ID NO: 423 (*pCA 70 L27V02A 167-169 FRB)
MILAGGGGSGGGSSVAILWHEMWHEGLEEASRLYFGERNVKGMFEVLEPLHAMMERGPQTLKETSFNQAYGRDLMEAQ
EWCRKYMKSGNVKDLTQAWDLYYHVFRRIS SEQ ID NO: 424 (pCA 71 FKBP L27V02A 1-164)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttttaaggtggtgtaccctgtggatgatcatcacttt
aaggtgatcctgcactatggcacactggtaatcgacggggttacgccgaacatgatcgactatttcggacggccgtat
gaaggcatcgccgtgttcgacggcaaaaagatcactgtaacagggaccctgtggaacggcaacaaaattatcgacgag
cgcctgatcaaccccgacggctccctgctgttccgagtaaccatcaacggagtgaccggctggcggctgtgc SEQ ID NO: 425 (pCA 71 FKBP L27V02A 1-164)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERLINPDGSLLFRVTINGVTGWRLC SEQ ID NO: 426 (pCA 72 L27V02A 165-169 FRB)
atggaacgcattctggcgggaggaggtggctcaggtggagggagctccgtggccatcctctggcatgagatgtggcat
gaaggcctggaagaggcatctcgtttgtactttggggaaaggaacgtgaaaggcatgtttgaggtgctggagcccttg
catgctatgatggaacggggcccccagactctgaaggaaacatcctttaatcaggcctatggtcgagatttaatggag
gcccaagagtggtgcaggaagtacatgaaatcagggaatgtcaaggacctcacccaagcctgggacctctattatcat
gtgttccgacgaatctca SEQ ID NO: 427 (pattern sequence)
GSAIVK SEQ ID NO: 428 (pCA 72 L27V02A 165-169 FRB)
MERILAGGGGSGGGSSVAILWHEMWHEGLEEASRLYFGERNVKGMFEVLEPLHAMMERGPQTLKETSFNQAYGRDLME
AQEWCRKYMKSGNVKDLTQAWDLYYHVFRRIS SEQ ID NO: 429 (pCA 73 FKBP L27V02A 1-162)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagccctttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttttaaggtggtgtaccctgtggatgatcatcacttt
aaggtgatcctgcactatggcacactggtaatcgacggggttacgccgaacatgatcgactatttcggacggccgtat
gaaggcatcgccgtgttcgacggcaaaaagatcactgtaacagggaccctgtggaacggcaacaaaattatcgacgag
cgcctgatcaaccccgacggctccctgctgttccgagtaaccatcaacggagtgaccggctggcgg SEQ ID NO: 430 (pCA 73 FKBP L27V02A 1-162)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERLINPDGSLLFRVTINGVTGWR SEQ ID NO: 431 (pCA 74 L27V02A 163-169 FRB)
atgctgtgcgaacgcattctggcgggaggaggtggctcaggtggagggagctccgtggccatcctctggcatgagatg
tggcatgaaggcctggaagaggcatctcgtttgtactttggggaaaggaacgtgaaaggcatgtttgaggtgctggag
cccttgcatgctatgatggaacggggcccccagactctgaaggaaacatcctttaatcaggcctatggtcgagattta
atggaggcccaagagtggtgcaggaagtacatgaaatcagggaatgtcaaggacctcacccaagcctgggacctctat
tatcatgtgttccgacgaatctca

SEQUENCE LISTING

SEQ ID NO: 432 (pCA 74 L27V02A 163-169 FRB)
MLCERILAGGGGSGGGSSVAILWHEMWHEGLEEASRLYFGERNVKGMFEVLEPLHAMMERGPQTLKETSFNQAYGRDL
MEAQEWCRKYMKSGNVKDLTQAWDLYYHVFRRIS

SEQ ID NO: 433 (pCA 75 FKBP L27V02A 1-160)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagcccttttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttaaggtggtgtaccctgtggatgatcatcactttt
aaggtgatcctgcactatggcacactggtaatcgacggggttacgccgaacatgatcgactatttcggacggccgtat
gaaggcatcgccgtgttcgacggcaaaaagatcactgtaacagggaccctgtggaacggcaacaaaattatcgacgag
cgcctgatcaaccccgacggctccctgctgttccgagtaaccatcaacggagtgaccggc SEQ ID NO: 434 (pCA 75 FKBP L27V02A 1-160)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERLINPDGSLLFRVTINGVTG SEQ ID NO: 435 (pCA 76 L27V02A 161-169 FRB)
atgtggcggctgtgcgaacgcattctggcgggaggaggtggctcaggtggagggagctccgtggccatcctctggcat
gagatgtggcatgaaggcctggaagaggcatctcgtttgtactttgggaaaggaacgtgaaaggcatgtttgaggtg
ctggagcccttgcatgctatgatggaacgggcccccagactctgaaggaaacatcctttaatcaggcctatggtcga
gatttaatggaggcccaagagtggtgcaggaagtacatgaaatcagggaatgtcaaggacctcacccaagcctgggac
ctctattatcatgtgttccgacgaatctca SEQ ID NO: 436 (pCA 76 L27V02A 161-169 FRB)
MWRLCERILAGGGGSGGGSSVAILWHEMWHEGLEEASRLYFGERNVKGMFEVLEPLHAMMERGPQTLKETSFNQAYGR
DLMEAQEWCRKYMKSGNVKDLTQAWDLYYHVFRRIS SEQ ID NO: 437 (pCA 77 FKBP L27V02A 1-158)
atgggagtgcaggtggaaaccatctccccaggagacgggcgcaccttccccaagcgcggccagacctgcgtggtgcac
tacaccgggatgcttgaagatggaaagaaatttgattcctcccgggacagaaacaagcccttttaagtttatgctaggc
aagcaggaggtgatccgaggctgggaagaaggggttgcccagatgagtgtgggtcagagagccaaactgactatatct
ccagattatgcctatggtgccactgggcacccaggcatcatcccaccacatgccactctcgtcttcgatgtggagctt
ctaaaactggaaggaggagggagctccggtggaggcagcggtatggtcttcacactcgaagatttcgttggggactgg
cgacagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaattttaaggtggtgtaccctgtggatgatcatcactttt
aaggtgatcctgcactatggcacactggtaatcgacggggttacgccgaacatgatcgactatttcggacggccgtat
gaaggcatcgccgtgttcgacggcaaaaagatcactgtaacagggaccctgtggaacggcaacaaaattatcgacgag
cgcctgatcaaccccgacggctccctgctgttccgagtaaccatcaacggagtg SEQ ID NO: 438 (pCA 77 FKBP L27V02A 1-158)
MGVQVETISPGDGRTFPKRGQTCVVHYTGMLEDGKKFDSSRDRNKPFKFMLGKQEVIRGWEEGVAQMSVGQRAKLTIS
PDYAYGATGHPGIIPPHATLVFDVELLKLEGGGSSGGGSGMVFTLEDFVGDWRQTAGYNLDQVLEQGGVSSLFQNLGV
SVTPIQRIVLSGENGLKIDIHVIIPYEGLSGDQMGQIEKIFKVVYPVDDHHFKVILHYGTLVIDGVTPNMIDYFGRPY
EGIAVFDGKKITVTGTLWNGNKIIDERLINPDGSLLFRVTINGV SEQ ID NO: 439 (pCA 78 L27V02A 159-169 FRB)
Atgaccggctggcggctgtgcgaacgcattctggcgggaggaggtggctcaggtggagggagctccgtggccatcctc
tggcatgagatgtggcatgaaggcctggaagaggcatctcgtttgtactttgggaaaggaacgtgaaaggcatgttt
gaggtgctggagcccttgcatgctatgatggaacgggcccccagactctgaaggaaacatcctttaatcaggcctat
ggtcgagatttaatggaggcccaagagtggtgcaggaagtacatgaaatcagggaatgtcaaggacctcacccaagcc
tgggacctctattatcatgtgttccgacgaatctca SEQ ID NO: 440 (pCA 78 L27V02A 159-169 FRB)
MTGWRLCERILAGGGGSGGGSSVAILWHEMWHEGLEEASRLYFGERNVKGMFEVLEPLHAMMERGPQTLKETSFNQAY
GRDLMEAQEWCRKYMKSGNVKDLTQAWDLYYHVFRRIS SEQ ID NO: 441 RIIbB (nt seq)
ATGTATGAAAGCTTTATTGAGTCACTGCCATTCCTTAAATCTTTGGAGTTTTCTGCACGCCTGAAAGTAGTAGATGTG
ATAGGCACCAAAGTATACAACGATGGAGAACAAATCATTGCTCAGGGAGATTCGGCTGATTCTTTTTTCATTATTGAA
TCTGGAGAAGTGAAAATTACTATGAAAAGAAAGGGTAAATCAGAAGTGGAAGAGAATGGTGCAGTAGAAATCGCTCGA
TGCTCGCGGGACAGTACTTTGGAGAGCTTGCCCTGGTAACTAACAAACCTGAGCAGCTTCTGCCCACGCCATTGGG
ACTGTCAAATGTTTAGCAATGATGTGCAAGCATTTGAAAGGCTTCTGGGACCTTGCATGGAAATTATGAAAAGGAAC
ATCGCTACCTATGAAGAACAGTTAGTTGCCCTGTATGGAACGAACATGGATATTGTA SEQ ID NO: 442 RIIbB (aa seq)
MYESFIESLPFLKSLEFSARLKVVDVIGTKVYNDGEQIIAQGDSADSFFIIESGEVKITMKRKGKSEVEENGAVEIAR
CSRGQYFGELALVTNKPRAASAHAIGTVKCLAMDVQAFERLLGPCMEIMKRNIATYEEQLVALYGTNMDIV

US 9,840,730 B2

243
244

-continued

SEQUENCE LISTING

SEQ ID NO: 443 (L27V CP 13 TEV)
atgacagccggctacaacctggaccaagtccttgagcagggcggtgtgtccagtttgtttcagaatctcggggtgtcc
gtaactccgatccaaaggattgtcctgagcggtgaaaacggcctgaagatcgacatccatgtcatcatcccgtatgaa
ggtctgagcggcgatcagatgggccagatcgaaaaaattttttaaggtggtgtaccctgtggatgatcatcactttaag
gtgattctgcactatggcacactggtaatcgacggggttacgccgaacatgatcgactatttcggacggccgtatgaa
ggcatcgccgtgttcgacggcaaaaagatcactgtaaccgggaccctgtggaacggcaacaaaattatcgacgagcgc
ctgatcaaccccgacggctccctgctgttccgcgtaaccatcaacggagtgaccggctggcggctgtgcgagcgcatt
ttggcgggaagttctggtggaggaagttctggtggagagcctactactgagaacttgtacttccagagcgataacgga
agttctggtggaggaagttctggtggaatggtgtttacactcgaagatttcgtaggggactggcggcag SEQ ID NO: 444 (L27V CP 13 TEV)
MTAGYNLDQVLEQGGVSSLFQNLGVSVTPIQRIVLSGENGLKIDIHVIIPYEGLSGDQMGQIEKIFKVVYPVDDHHFK
VILHYGTLVIDGVTPNMIDYFGRPYEGIAVFDGKKITVTGTLWNGNKIIDERLINPDGSLLFRVTINGVTGWRLCERI
LAGSSGGGSSGGEPTTENLYFQSDNGSSGGGSSGGMVFTLEDFVGDWRQ SEQ ID NO: 445 (L27V CP 57 TEV)
Atgcatgtcatcatcccgtatgaaggtctgagcggcgatcagatgggccagatcgaaaaaattttttaaggtggtgtac
cctgtggatgatcatcactttaaggtgattctgcactatggcacactggtaatcgacggggttacgccgaacatgatc
gactatttcggacggccgtatgaaggcatcgccgtgttcgacggcaaaaagatcactgtaaccgggaccctgtggaac
ggcaacaaaattatcgacgagcgcctgatcaaccccgacggctccctgctgttccgcgtaaccatcaacggagtgacc
ggctggcggctgtgcgagcgcattttggcgggaagttctggtggaggaagttctggtggagagcctactactgagaac
ttgtacttccagagcgataacggaagttctggtggaggaagttctggtggaatggtgtttacactcgaagatttcgta
ggggactggcggcagacagccggctacaacctggaccaagtccttgagcagggcggtgtgtccagtttgtttcagaat
ctcggggtgtccgtaactccgatccaaaggattgtcctgagcggtgaaaacggcctgaagatcgacatc SEQ ID NO: 446 (L27V CP 57 TEV)
MHVIIPYEGLSGDQMGQIEKIFKVVYPVDDHHFKVILHYGTLVIDGVTPNMIDYFGRPYEGIAVFDGKKITVTGTLWN
GNKIIDERLINPDGSLLFRVTINGVTGWRLCERILAGSSGGGSSGGEPTTENLYFQSDNGSSGGGSSGGMVFTLEDFV
GDWRQTAGYNLDQVLEQGGVSSLFQNLGVSVTPIQRIVLSGENGLKIDI SEQ ID NO: 447 (L27V CP 98 TEV)
atggtaatcgacggggttacgccgaacatgatcgactatttcggacggccgtatgaaggcatcgccgtgttcgacggc
aaaaagatcactgtaaccgggaccctgtggaacggcaacaaaattatcgacgagcgcctgatcaaccccgacggctcc
ctgctgttccgcgtaaccatcaacggagtgaccggctggcggctgtgcgagcgcattttggcgggaagttctggtgga
ggaagttctggtggagagcctactactgagaacttgtacttccagagcgataacggaagttctggtggaggaagttct
ggtggaatggtgtttacactcgaagatttcgtaggggactggcggcagacagccggctacaacctggaccaagtcctt
gagcagggcggtgtgtccagtttgtttcagaatctcggggtgtccgtaactccgatccaaaggattgtcctgagcggt
gaaaacggcctgaagatcgacatccatgtcatcatcccgtatgaaggtctgagcggcgatcagatgggccagatcgaa
aaaattttttaaggtggtgtaccctgtggatgatcatcactttaaggtgattctgcactatggcacactg SEQ ID NO: 448 (L27V CP 98 TEV)
MVIDGVTPNMIDYFGRPYEGIAVFDGKKITVTGTLWNGNKIIDERLINPDGSLLFRVTINGVTGWRLCERILAGSSGG
GSSGGEPTTENLYFQSDNGSSGGGSSGGMVFTLEDFVGDWRQTAGYNLDQVLEQGGVSSLFQNLGVSVTPIQRIVLSG
ENGLKIDIHVIIPYEGLSGDQMGQIEKIFKVVYPVDDHHFKVILHYGTL SEQ ID NO: 449 (Human Protein Kinase C alpha (PKCa) (nt sequence)
ATGGCTGACGTTTTCCCGGGCAACGACTCCACGGCGTCTCAGGACGTGGCCAACCGCTTCGCCCGCAAAGGGGCGCTG
AGGCAGAAGAACGTGCACGAGGTGAAGGACCACAAATTCATCGCGCGCTTCTTCAAGCAGCCCACCTTCTGCAGCCAC
TGCACCGACTTCATCTGGGGGTTTGGGAAACAAGGCTTCCAGTGCCAAGTTTGCTGTTTTGTGGTCCACAAGAGGTGC
CATGAATTTGTTACTTTTTCTTGTCCGGGTGCGGATAAGGGACCCGACACTGATGACCCCAGGAGCAAGCACAAGTTC
AAAATCCACACTTACGGAAGCCCCACCTTCTGCGATCACTGTGGGTCACTGCTCTATGGACTTATCCATCAAGGGATG
AAATGTGACACCTGCGATATGAACGTTCACAAGCAATGCGTCATCAATGTCCCAGCCTCTGCGGAATGGATCACACT
GAGAAGAGGGGGCGGATTTACCTAAAGGCTGAGGTTGCTGATGAAAAGCTCCATGTCACAGTACGAGATGCAAAAAT
CTAATCCCTATGGATCCAAACGGGCTTTCAGATCCTTATGTGAAGCTGAAACTTATTCCTGATCCCAAGAATGAAAGC
AAGCAAAAAACCAAAACCATCCGCTCCACACTAAATCCGCAGTGGAATGAGTCCTTTACATTCAAATTGAAACCTTCA
GACAAAGACCGACGACTGTCTGTAGAAATCTGGGACTGGGATCGAACAACAAGGAATGACTTCATGGGATCCCTTTCC
TTTGGAGTTTCGGAGCTGATGAAGATGCCGGCCAGTGGATGGTACAAGTgCTTAACCAAGAAGAAGGTGAGTACTAC
AACGTACCCATTCCGGAAGGGGACGAGGAAGGAAACATGGAACTCAGGCAGAAATTGAGAAAGCCAAACTTGGCCCT
GCTGGCAACAAAGTCATCAGTCCCTCTGAAGACAGGAAACAACCTTCCAACAACCTTGACCGAGTGAAACTCACGGAC
TTCAATTTCCTCATGGTGTTGGGAAAGGGGAGTTTTGGAAAGGTGATGCTTCCGACAGGAAGGGCACAGAAGAACTG
TATGCAATCAAAATCCTGAAGAAGGATGTGGTGATTCAGGATGATGACGTGGAGTGCACCATGGTAGAAAAGCGAGTC
TTGGCCCTGCTTGACAAACCCCCGTTCTTGACGCAGCTGCACTCCTGCTTCCAGACAGTGGATCGGCTGTACTTCGTC
ATGGAATATGTCAACGGTGGGGACCTCATGTACCACATTCAGCAAGTAGGAAAATTTAAGGAACCACAAGCAGTATTC
TATGCGGCAGAGATTTCCATCGGATTGTTCTTTCTTCATAAAAGAGGAATCATTTATAGGGATCTGAAGTTAGATAAC
GTCATGTTGGATTCAGAAGGACATATCAAAATTGCTGACTTTGGGATGTGCAAGGAACACATGATGGATGGAGTCACG
ACCAGGACCTTCTGTGGGACTCCAGATTATATCGCCCCAGAGATAATCGCTTATCAGCCGTATGGAAAATCTGTGGAC
TGGTGGGCCTATGGCGTCCTGTTGTATGAAATGCTTGCCGGGCAGCCTCCATTTGATGGTGAAGATGAAGACGAGCTA
TTTCAGTCTATCATGGAGCACAACGTTTCCTATCCAAAATCCTTGTCCAAGGAGGCTGTTTCTATCTGCAAGGACTG
ATGACCAAACACCCAGCCAAGCGGCTGGGCTGTGGGCCTGAGGGGGAGAGGGACGTGAGAGAGCATGCCTTCTTCCGG
AGGATCGACTGGGAAAAACTGGAGAACAGGGAGATCCAGCCACCATTCAAGCCCAAAGTGTGTGGCAAAGGAGCAGAG
AACTTTGACAAGTTCTTCACACGAGGACAGCCCGTCTTAACACCACCTGATCAGCTGGTTATTGCTAACATAGACCAG
TCTGATTTTGAAGGGTTCTCGTATGTCAACCCCCAGTTTGTGCACCCCATCTTACAGAGTGCAGTAGTT SEQ ID NO: 450 (Human Protein Kinase C alpha (PKCa) (aa sequence)
MADVFPGNDSTASQDVANRFARKGALRQKNVHEVKDHKFIARFFKQPTFCSHCTDFIWGFGKQGFQCQVCCFVVHKRC
HEFVTFSCPGADKGPDTDDPRSKHKFKIHTYGSPTFCDHCGSLLYGLIHQGMKCDTCDMNVHKQCVINVPSLCGMDHT

SEQUENCE LISTING

```
EKRGRIYLKAEVADEKLHVTVRDAKNLIPMDPNGLSDPYVKLKLIPDPKNESKQKTKTIRSTLNPQWNESFTFKLKPS
DKDRRLSVEIWDWDRTTRNDFMGSLSFGVSELMKMPASGWYKLLNQEEGEYYNVPIPEGDEEGNMELRQKFEKAKLGP
AGNKVISPSEDRKQPSNNLDRVKLTDFNFLMVLGKGSFGKVMLADRKGTEELYAIKILKKDVVIQDDDVECTMVEKRV
LALLDKPPFLTQLHSCFQTVDRLYFVMEYVNGGDLMYHIQQVGKFKEPQAVFYAAEISIGLFFLHKRGIIYRDLKLDN
VMLDSEGHIKIADFGMCKEHMMDGVTTRTFCGTPDYIAPEIIAYQPYGKSVDWWAYGVLLYEMLAGQPPFDGEDEDEL
FQSIMEHNVSYPKSLSKEAVSICKGLMTKHPAKRLGCGPEGERDVREHAFFRRIDWEKLENREIQPPFKPKVCGKGAE
NFDKFFTRGQPVLTPPDQLVIANIDQSDFEGFSYVNPQFVHPILQSAVV

SEQ ID NO: 451 (Human Glucocorticoid receptor (GR) (nt sequence)
ATGGACTCCAAAGAATCATTAACTCCTGGTAGAGAAGAAAACCCCAGCAGTGTGCTTGCTCAGGAGAGGGGAGATGTG
ATGGACTTCTATAAAACCCTAAGAGGAGGAGCTACTGTGAAGGTTTCTGCGTCTTCACCCTCACTGGCTGTCGCTTCT
CAATCAGACTCCAAGCAGCGAAGACTTTTGGTTGATTTTCCAAAAGGCTCAGTAAGCAATGCGCAGCAGCCAGATCTG
TCCAAAGCAGTTTCACTCTCAATGGGACTGTATATGGGAGAGACAGAAACAAAGTGATGGGAAATGACCTGGGATTC
CCACAGCAGGGCCAAATCAGCCTTTCCTCGGGGGAAACAGACTTAAAGCTTTTGGAAGAAAGCATTGCAAACCTCAAT
AGGTCGACCAGTGTTCCAGAGAACCCCAAGAGTTCAGCATCCACTGCTGTGTCTGCTGCCCCCACAGAGAAGGAGTTT
CCAAAAACTCACTCTGATGTATCTTCAGAACAGCAACATTTGAAGGGCCAGACTGGCACCAACGGTGGCAATGTGAAA
TTGTATACCACAGACCAAAGCACCTTTGACATTTTGCAGGATTTGGAGTTTTCTTCTGGGTCCCCAGGTAAAGAGACG
AATGAGAGTCCTTGGAGATCAGACCTGTTGATAGATGAAAACTGTTTGCTTTCTCCTCTGGCGGGAGAAGACGATTCA
TTCCTTTTGGAAGGAAACTCGAATGAGGACTGCAAGCCTCTCATTTTACCGGACACTAAACCCAAAATTAAGGATAAT
GGAGATCTGGTTTTGTCAAGCCCCAGTAATGTAACACTGCCCCAAGTGAAAACAGAAAAAGAAGATTTCATCGAACTC
TGCACCCCTGGGGTAATTAAGCAAGAGAAACTGGGCACAGTTTACTGTCAGGCAAGCTTTCCTGGAGCAAATATAATT
GGTAATAAAATGTCTGCCATTTCTGTTCATGGTGTGAGTACCTCTGGAGGACAGATGTACCACTATGACATGAATACA
GCATCCCTTTCTCAACAGCAGGATCAGAAGCCTATTTTTAATGTCATTCCACCAATTCCCGTTGGTTCCGAAAATTGG
AATAGGTGCCAAGGATCTGGAGATGACAACTTGACTTCTCTGGGGACTCTGAACTTCCCTGGTCGAACAGTTTTTTCT
AATGGCTATTCAAGCCCCAGCATGAGACCAGATGTAAGCTCTCCTCCATCCAGCTCCTCAACAGCAACAACAGGACCA
CCTCCCAAACTCTGCCTGGTGTGCTCTGATGAAGCTTCAGGATGCATTATGGAGTCTTAACTTGTGGAAGCTGTAAA
GTTTTCTTCAAAAGAGCAGTGGAAGGACAGCACAATTACCTATGTGCTGGAAGGAATGATTGCATCATCGATAAAATT
CGAAGAAAAAACTGCCCAGCATGCCGCTATCGAAAATGTCTTCAGGCTGGAATGAACCTGGAAGCTCGAAAAACAAAG
AAAAAAATAAAAGGAATTCAGCAGGCCACTACAGGAGTCTCACAAGAAACCTCTGAAAATCCTGGTAACAAAACAATA
GTTCCTGCAACGTTACCACAACTCACCCCTACCCTGGTGTCACTGTTGGAGGTTATTGAACCTGAAGTGTTATATGCA
GGATATGATAGCTCTGTTCCAGACTCAACTTGGAGGATCATGACTACGCTCAACATGTTAGGAGGGCGGCAAGTGATT
GCAGCAGTGAAATGGGCAAAGGCAATACCAGGTTTCAGGAACTTACACCTGGATGACCAAATGACCCTACTGCAGTAC
TCCTGGATGTTTCTTATGGCATTTGCTCTGGGGTGGAGATCATATAGACAATCAAGTGCAAACCTGCTGTGTTTTGCT
CCTGATCTGATTATTAATGAGCAGAGAATGACTCTACCCTGCATGTACGACCAATGTAAACACATGCTGTATGTTTCC
TCTGAGTTACACAGGCTTCAGGTATCTTATGAAGAGTATCTCTGTATGAAAACCTTACTGCTTCTCTCTTCAGTTCCT
AAGGACGGTCTGAAGAGCCAAGAGCTATTTGATGAAATTAGAATGACCTACATCAAAGAGCTAGGAAAAGCCATTGTC
AAGAGGGAAGGAAACTCCAGCCAGAACTGGCAGCGGTTTTATCAACTGACAAAACTCTTGGATTCTATGCATGAAGTG
GTTGAAAATCTCCTTAACTATTGCTTCCAAACATTTTTGGATAAGACCATGAGTATTGAATTCCCCGAGATGTTAGCT
GAAATCATCACCAATCAGATACCAAAATATTCAAATGGAAATATCAAAAAACTTCTGTTTCATCAAAAGGTT SEQ ID NO: 452 (Human Glucocorticoid receptor (GR) (aa sequence)
MDSKESLTPGREENPSSVLAQERGDVMDFYKTLRGGATVKVSASSPSLAVASQSDSKQRRLLVDFPKGSVSNAQQPDL
SKAVSLSMGLYMGETETKVMGNDLGFPQQGQISLSSGETDLKLLEESIANLNRSTSVPENPKSSASTAVSAAPTEKEF
PKTHSDVSSEQQHLKGQTGTNGGNVKLYTTDQSTFDILQDLEFSSGSPGKETNESPWRSDLLIDENCLLSPLAGEDDS
FLLEGNSNEDCKPLILPDTKPKIKDNGDLVLSSPSNVTLPQVKTEKEDFIELCTPGVIKQEKLGTVYCQASFPGANII
GNKMSAISVHGVSTSGGQMYHYDMNTASLSQQQDQKPIFNVIPPIPVGSENWNRCQGSGDDNLTSLGTLNFPGRTVFS
NGYSSPSMRPDVSSPPSSSTATTGPPPKLCLVCSDEASGCHYGVLTCGSCKVFFKRAVEGQHNYLCAGRNDCIIDKI
RRKNCPACRYRKCLQAGMNLEARKTKKKIKGIQQATTGVSQETSENPGNKTIVPATLPQLTPTLVSLLEVIEPEVLYA
GYDSSVPDSTWRIMTTLNMLGGRQVIAAVKWAKAIPGFRNLHLDDQMTLLQYSWMFLMAFALGWRSYRQSSANLLCFA
PDLIINEQRMTLPCMYDQCKHMLYVSSELHRLQVSYEEYLCMKTLLLLSSVPKDGLKSQELFDEIRMTYIKELGKAIV
KREGNSSQNWQRFYQLTKLLDSMHEVVENLLNYCFQTFLDKTMSIEFPEMLAEIITNQIPKYSNGNIKKLLFHQKV SEQ ID NO: 453 (L27V02-GR/L27V02-PKCa linker (nt sequence)
GGTGGTTCAGGTGGTGGCGGGAGCGGTGGAGGGAGCAGCGGTGGAGCGATCGCC SEQ ID NO: 454 (L27V02-GR/L27V02-PKCa linker (aa sequence)
GGSGGGGSGGGSSGGAIA SEQ ID NO: 455 (GR-L27V02/PKCa-L27V02 linker (nt sequence)
TCTCTCGGTGGTTCAGGTGGTGGCGGGAGCGGTGGAGGGAGCAGCGGTGGA SEQ ID NO: 456 (GR-L27V02/PKCa-L27V02 linker (aa sequence)
SLGGSGGGGSGGGSSGG SEQ ID NO: 457 (GSSG linker (nt sequence)
GCTCGAGCGGA SEQ ID NO: 458 (GSSG linker (aa sequence)
GSSG SEQ ID NO: 459 (AT1R (nt sequence)
ATGATTCTCAACTCTTCTACTGAAGATGGTATTAAAAGAATCCAAGATGATTGTCCCAAAGCTGGAAGGCATAATTAC
ATATTTGTCATGATTCCTACTTTATACAGTATCATCTTTGTGGTGGGAATATTTGGAAACAGCTTGGTGGTGATAGTC
ATTTACTTTTATATGAAGCTGAAGACTGTGGCCAGTGTTTTTCTTTTGAATTTAGCACTGGCTGACTTATGCTTTTTA
CTGACTTTGCCACTATGGGCTGTCTACACAGCTATGGAATACCGCTGGCCCTTTGGCAATTACCTATGTAAGATTGCT
TCAGCCAGCGTCAGTTTCAACCTGTACGCTAGTGTGTTTCTACTCACGTGTCTCAGCATTGATCGATACCTGGCTATT
GTTCACCCAATGAAGTCCCGCCTTCGACGCACAATGCTTGTAGCCAAAGTCACCTGCATCATCATTTGGCTGCTGGCA
```

```
                        SEQUENCE LISTING
GGCTTGGCCAGTTTGCCAGCTATAATCCATCGAAATGTATTTTTCATTGAGAACACCAATATTACAGTTTGTGCTTTC
CATTATGAGTCCCAAAATTCAACCCTTCCGATAGGGCTGGGCCTGACCAAAAATATACTGGGTTTCCTGTTTCCTTTT
CTGATCATTCTTACAAGTTATACTCTTATTTGGAAGGCCTAAAGAAGGCTTATGAAATTCAGAAGAACAAACCAAGA
AATGATGATATTTTTAAGATAATTATGGCAATTGTGCTTTTCTTTTTCTTTTCCTGGATTCCCCACCAAATATTCACT
TTTCTGGATGTATTGATTCAACTAGGCATCATACGTGACTGTAGAATTGCAGATATTGTGGACACGGCCATGCCTATC
ACCATTTGTATAGCTTATTTTAACAATTGCCTGAATCCTCTTTTTTATGGCTTTCTGGGGAAAAAATTTAAAAGATAT
TTTCTCCAGCTTCTAAAATATATTCCCCCAAAAGCCAAATCCCACTCAAACCTTTCAACAAAAATGAGCACGCTTTCC
TACCGCCCCTCAGATAATGTAAGCTCATCCACCAAGAAGCCTGCACCATGTTTTGAGGTTGAGTGA

SEQ ID NO: 460 (AT1R (aa sequence)
MILNSSTEDGIKRIQDDCPKAGRHNYIFVMIPTLYSIIFVVGIFGNSLVVIVIYFMKLKTVASVFLLNLALADLCFL
LTLPLWAVYTAMEYRWPFGNYLCKIASASVSFNLYASVFLLTCLSIDRYLAIVHPMKSRLRRTMLVAKVTCIIIWLLA
GLASLPAIIHRNVFFIENTNITVCAFHYESQNSTLPIGLGLTKNILGFLPPFLIILTSYTLIWKALKKAYEIQKNKPR
NDDIFKIIMAIVLFFFSWIPHQIFTFLDVLIQLGIIRDCRIADIVDTAMPITICIAYFNNCLNPLFYGFLGKKFKRY
FLQLLKYIPPKAKSHSNLSTKMSTLSYRPSDNVSSSTKKPAPCFEVE SEQ ID NO: 461 (IL6-00 signal peptide (nt sequence)
ATGAACTCCTTCTCCACAAGCGCCTTCGGTCCAGTTGCCTTCTCCCTGGGGCTGCTCCTGGTGTTGCCTGCTGCCTTC
CCTGCCCCA SEQ ID NO: 462 (IL6-00 signal peptide (aa sequence)
MNSFSTSAFGPVAFSLGLLLVLPAAFPAP SEQ ID NO: 463 (IL6-00 L27V-00 (nt sequence)
ATGAACTCCTTCTCCACAAGCGCCTTCGGTCCAGTTGCCTTCTCCCTGGGGCTGCTCCTGGTGTTGCCTGCTGCCTTC
CCTGCCCCAGTGTTTACACTCGAAGATTTCGTAGGGGACTGGCGGCAGACAGCCGGCTACAACCTGGACCAAGTCCTT
GAGCAGGGCGGTGTGTCCAGTTTGTTTCAGAATCTCGGGGTGTCCGTAACTCCGATCCAAAGGATTGTCCTGAGCGGT
GAAAACGGCCTGAAGATCGACATCCATGTCATCATCCCGTATGAAGGTCTGAGCGGCGATCAGATGGGCCAGATCGAA
AAAATTTTTAAGGTGGTGTACCCTGTGGATGATCATCACTTTAAGGTGATTCTGCACTATGGCACACTGGTAATCGAC
GGGGTTACGCCGAACATGATCGACTATTTCGGACGGCCGTATGAAGGCATCGCCGTGTTCGACGGCAAAAAGATCACT
GTAACCGGGACCCTGTGGAACGGCAACAAAATTATCGACGAGCGCCTGATCAACCCCGACGGCTCCCTGCTGTTCCGC
GTAACCATCAACGGAGTGACCGGCTGGCGGCTGTGCGAGCGCATTTTGGCG SEQ ID NO: 464 (IL6-00 L27V-00 (aa sequence)
MNSFSTSAFGPVAFSLGLLLVLPAAFPAPVFTLEDFVGDWRQTAGYNLDQVLEQGGVSSLFQNLGVSVTPIQRIVLSG
ENGLKIDIHVIIPYEGLSGDQMGQIEKIFKVVYPVDDHHFKVILHYGTLVIDGVTPNMIDYFGRPYEGIAVFDGKKIT
VTGTLWNGNKIIDERLINPDGSLLFRVTINGVTGWRLCERILA SEQ ID NO: 465 (Native secretion signal + L27V (nt sequence)
atggcttactccacactgttcatcattgctctcacagccgtcgtaacacaagcctcctccacacagaaaagcaacctg
acaGTGTTTACACTCGAAGATTTCGTAGGGGACTGGCGGCAGACAGCCGGCTACAACCTGGACCAAGTCCTTGAGCAG
GGCGGTGTGTCCAGTTTGTTTCAGAATCTCGGGGTGTCCGTAACTCCGATCCAAAGGATTGTCCTGAGCGGTGAAAAC
GGCCTGAAGATCGACATCCATGTCATCATCCCGTATGAAGGTCTGAGCGGCGATCAGATGGGCCAGATCGAAAAAATT
TTTAAGGTGGTGTACCCTGTGGATGATCATCACTTTAAGGTGATTCTGCACTATGGCACACTGGTAATCGACGGGGTT
ACGCCGAACATGATCGACTATTTCGGACGGCCGTATGAAGGCATCGCCGTGTTCGACGGCAAAAAGATCACTGTAACC
GGGACCCTGTGGAACGGCAACAAAATTATCGACGAGCGCCTGATCAACCCCGACGGCTCCCTGCTGTTCCGCGTAACC
ATCAACGGAGTGACCGGCTGGCGGCTGTGCGAGCGCATTTTGGCG SEQ ID NO: 466 (Native secretion signal + L27V (aa sequence)
MAYSTLFIIALTAVVTQASSTQKSNLTVFTLEDFVGDWRQTAGYNLDQVLEQGGVSSLFQNLGVSVTPIQRIVLSGEN
GLKIDIHVIIPYEGLSGDQMGQIEKIFKVVYPVDDHHFKVILHYGTLVIDGVTPNMIDYFGRPYEGIAVFDGKKITVT
GTLWNGNKIIDERLINPDGSLLFRVTINGVTGWRLCERILA SEQ ID NO: 467 (CP 6 L27V (RIIbB) (nt sequence) (nt sequence)
Atgttcgttggggactggcgacagacagccggctacaacctggaccaagtccttgaacagggaggtgtgtccagtttg
tttcagaatctcggggtgtccgtaactccgatccaaaggattgtcctgagcggtgaaaatgggctgaagatcgacatc
catgtcatcatcccgtatgaaggtctgagcggcgaccaaatgggccagatcgaaaaaattttttaaggtggtgtaccct
gtggatgatcatcactttaaggtgatcctgcactatggcacactggtaatcgacggggttacgccgaacatgatcgac
tatttcggacggccgtatgaaggcatcgccgtgttcgacggcaaaaagatcactgtaaccgggaccctgtggaacggc
aacaaaattatcgacgagcgcctgatcaaccccgacggctccctgctgttccgagtaaccatcaacggagtgaccggc
tggcggctgtGCGAACGCATTCTGGCTAGCTCCAAGCGGAGGTTCAGGCGGTTCCGGAATGTATGAAAGCTTTATTGAG
TCACTGCCATTCCTTAAATCTTTGGAGTTTTCTGCACGCCTGAAAGTAGTAGATGTGATAGGCACCAAAGTATACAAC
GATGGAGAACAAATCATTGCTCAGGGAGATTCGGCTGATTCTTTTTTCATTATTGAATCGGAGAAGTGAAAATTACT
ATGAAAAGAAAGGGTAAATCAGAAGTGGAAGAGAATGGTGCAGTAGAAATCGCTCGATGCTCGCGGGGACAGTACTTT
GGAGAGCTTGCCCTGGTAACTAACAAACCTCGAGCAGCTTCTGCCCACGCCATTGGGACTGTCAAATGTTTAGCAATG
GATGTGCAAGCATTTGAAAGGCTTCTGGGACCTTGCATGGAAATTATGAAAAGGAACATCGCTACCTATGAAGAACAG
TTAGTTGCCCTGTATGGAACGAACATGGATATTGTAGGGTCAGGTGGATCTGGAGGTAGCTCTTCTatggtcttcaca
ctcgaagat SEQ ID NO: 468 (CP 6 L27V (RIIbB) (aa seq)
MFVGDWRQTAGYNLDQVLEQGGVSSLFQNLGVSVTPIQRIVLSGENGLKIDIHVIIPYEGLSGDQMGQIEKIFKVVYP
VDDHHFKVILHYGTLVIDGVTPNMIDYFGRPYEGIAVFDGKKITVTGTLWNGNKIIDERLINPDGSLLFRVTINGVTG
WRLCERILASSSGGSGSGSGMYESFIESLPFLKSLEFSARLKVVDVIGTKVYNDGEQIIAQGDSADSFFIIESGEVKIT
MKRKGKSEVEENGAVEIARCSRGQYFGELALVTNKPRAASAHAIGTVKCLAMDVQAFERLLGPCMEIMKRNIATYEEQ
LVALYGTNMDIVGSGGSGGSSSMVFTLED
```

-continued

SEQUENCE LISTING

SEQ ID NO: 469 (CP 12 L27V (RIIbB) (nt sequence) (nt sequence)
ATGcagacagccggctacaacctggaccaagtccttgaacagggaggtgtgtccagtttgtttcagaatctcggggtg
tccgtaactccgatccaaaggattgtcctgagcggtgaaaatgggctgaagatcgacatccatgtcatcatcccgtat
gaaggtctgagcggcgaccaaatgggccagatcgaaaaaatttttaaggtggtgtaccctgtggatgatcatcacttt
aaggtgatcctgcactatggcacactggtaatcgacggggttacgccgaacatgatcgactatttcggacggccgtat
gaaggcatcgccgtgttcgacggcaaaaagatcactgtaacagggaccctgtggaacggcaacaaaattatcgacgag
cgcctgatcaaccccgacggctccctgctgttccgagtaaccatcaacggagtgaccggctggcggctgtGCGAACGC
ATTCTGGCtAGCTCAAGCGGAGGTTCAGGCGGTTCCGGAATGTATGAAAGCTTTATTGAGTCACTGCCATTCCTTAAA
TCTTTGGAGTTTTCTGCACGCCTGAAAGTAGTAGATGTGATAGGCACCAAAGTATACAACGATGGAGAACAAATCATT
GCTCAGGGAGATTCGGCTGATTCTTTTTTCATTATTGAATCTGGAGAAGTGAAAATTACTATGAAAAGAAAGGGTAAA
TCAGAAGTGGAAGAGAATGGTGCAGTAGAAATCGCTCGATGCTCGCGGGGACAGTACTTTGGAGAGCTTGCCCTGGTA
ACTAACAAACCTCGAGCAGCTTCTGCCCACGCCATTGGGACTGTCAAATGTTTAGCAATGGATGTGCAAGCATTTGAA
AGGCTTCTGGGACCTTGCATGGAAATTATGAAAAGGAACATCGCTACCTATGAAGAACAGTTAGTTGCCCTGTATGGA
ACGAACATGGATATTGTAGGGTCAGGTGGATCTGGAGGTAGCTCTTCTatggtcttcacactcgaagatttcgttggg
gactggcga SEQ ID NO: 470 (CP 12 L27V (RIIbB) (aa seq)
MQTAGYNLDQVLEQGGVSSLFQNLGVSVTPIQRIVLSGENGLKIDIHVIIPYEGLSGDQMGQIEKIFKVVYPVDDHHF
KVILHYGTLVIDGVTPNMIDYFGRPYEGIAVFDGKKITVTGTLWNGNKIIDERLINPDGSLLFRVTINGVTGWRLCER
ILASSSGGSGGSGMYESFIESLPFLKSLEFSARLKVVDVIGTKVYNDGEQIIAQGDSADSFFIIESGEVKITMKRKGK
SEVEENGAVEIARCSRGQYFGELALVTNKPRAASAHAIGTVKCLAMDVQAFERLLGPCMEIMKRNIATYEEQLVALYG
TNMDIVGSGGSGGSSSMVFTLEDFVGDWR SEQ ID NO: 471 (CP 48 L27V (RIIbB) (nt sequence)
ATGggtgaaaatgggctgaagatcgacatccatgtcatcatcccgtatgaaggtctgagcggcgaccaaatgggccag
atcgaaaaaatttttaaggtggtgtaccctgtggatgatcatcactttaaggtgatcctgcactatggcacactggta
atcgacggggttacgccgaacatgatcgactatttcggacggccgtatgaaggcatcgccgtgttcgacggcaaaaag
atcactgtaacagggaccctgtggaacggcaacaaaattatcgacgagcgcctgatcaaccccgacggctccctgctg
ttccgagtaaccatcaacggagtgaccggctggcggctgtGCGAACGCATTCTGGCtAGCTCAAGCGGAGGTTCAGGC
GGTTCCGGAATGTATGAAAGCTTTATTGAGTCACTGCCATTCCTTAAATCTTTGGAGTTTTCTGCACGCCTGAAAGTA
GTAGATGTGATAGGCACCAAAGTATACAACGATGGAGAACAAATCATTGCTCAGGGAGATTCGGCTGATTCTTTTTTC
ATTATTGAATCTGGAGAAGTGAAAATTACTATGAAAAGAAAGGGTAAATCAGAAGTGGAAGAGAATGGTGCAGTAGAA
ATCGCTCGATGCTCGCGGGGACAGTACTTTGGAGAGCTTGCCCTGGTAACTAACAAACCTCGAGCAGCTTCTGCCCAC
GCCATTGGGACTGTCAAATGTTTAGCAATGGATGTGCAAGCATTTGAAAGGCTTCTGGGACCTTGCATGGAAATTATG
AAAAGGAACATCGCTACCTATGAAGAACAGTTAGTTGCCCTGTATGGAACGAACATGGATATTGTAGGGTCAGGTGGA
TCTGGAGGTAGCTCTTCTatggtcttcacactcgaagatttcgttggggactggcgacagacagccggctacaacctg
gaccaagtccttgaacagggaggtgtgtccagtttgtttcagaatctcggggtgtccgtaactccgatccaaaggatt
gtcctgagc SEQ ID NO: 472 (CP 48 L27V (RIIbB) (aa seq)
MGENGLKIDIHVIIPYEGLSGDQMGQIEKIFKVVYPVDDHHFKVILHYGTLVIDGVTPNMIDYFGRPYEGIAVFDGKK
ITVTGTLWNGNKIIDERLINPDGSLLFRVTINGVTGWRLCERILASSSGGSGGSGMYESFIESLPFLKSLEFSARLKV
VDVIGTKVYNDGEQIIAQGDSADSFFIIESGEVKITMKRKGKSEVEENGAVEIARCSRGQYFGELALVTNKPRAASAH
AIGTVKCLAMDVQAFERLLGPCMEIMKRNIATYEEQLVALYGTNMDIVGSGGSGGSSSMVFTLEDFVGDWRQTAGYNL
DQVLEQGGVSSLFQNLGVSVTPIQRIVLS SEQ ID NO: 473 (CP 52 L27V (RIIbB) (nt sequence)
ATGCTGAAGATCGACATCCATGTCATCATCCCGTATGAAGGTCTGAGCGGCGACCAAATGGGCCAGATCGAAAAAATT
TTTAAGGTGGTGTACCCTGTGGATGATCATCACTTTAAGGTGATCCTGCACTATGGCACACTGGTAATCGACGGGGTT
ACGCCGAACATGATCGACTATTTCGGACGGCCGTATGAAGGCATCGCCGTGTTCGACGGCAAAAAGATCACTGTAACA
GGGACCCTGTGGAACGGCAACAAAATTATCGACGAGCGCCTGATCAACCCCGACGGCTCCCTGCTGTTCCGAGTAACC
ATCAACGGAGTGACCGGCTGGCGGCTGTGCGAACGCATTCTGGCTAGCTCAAGCGGAGGTTCAGGCGGTTCCGGAATG
TATGAAAGCTTTATTGAGTCACTGCCATTCCTTAAATCTTTGGAGTTTTCTGCACGCCTGAAAGTAGTAGATGTGATA
GGCACCAAAGTATACAACGATGGAGAACAAATCATTGCTCAGGGAGATTCGGCTGATTCTTTTTTCATTATTGAATCT
GGAGAAGTGAAAATTACTATGAAAAGAAAGGGTAAATCAGAAGTGGAAGAGAATGGTGCAGTAGAAATCGCTCGATGC
TCGCGGGGACAGTACTTTGGAGAGCTTGCCCTGGTAACTAACAAACCTCGAGCAGCTTCTGCCCACGCCATTGGGACT
GTCAAATGTTTAGCAATGGATGTGCAAGCATTTGAAAGGCTTCTGGGACCTTGCATGGAAATTATGAAAAGGAACATC
GCTACCTATGAAGAACAGTTAGTTGCCCTGTATGGAACGAACATGGATATTGTAGGGTCAGGTGGATCTGGAGGTAGC
TCTTCTATGGTCTTCACACTCGAAGATTTCGTTGGGGACTGGCGACAGACAGCCGGCTACAACCTGGACCAAGTCCTT
GAACAGGGAGGTGTGTCCAGTTTGTTTCAGAATCTCGGGGTGTCCGTAACTCCGATCCAAAGGATTGTCCTGAGCGGT
GAAAATGGG SEQ ID NO: 474 (CP 52 L27V (RIIbB) (aa seq)
MLKIDIHVIIPYEGLSGDQMGQIEKIFKVVYPVDDHHFKVILHYGTLVIDGVTPNMIDYFGRPYEGIAVFDGKKITVT
GTLWNGNKIIDERLINPDGSLLFRVTINGVTGWRLCERILASSSGGSGGSGMYESFIESLPFLKSLEFSARLKVVDVI
GTKVYNDGEQIIAQGDSADSFFIIESGEVKITMKRKGKSEVEENGAVEIARCSRGQYFGELALVTNKPRAASAHAIGT
VKCLAMDVQAFERLLGPCMEIMKRNIATYEEQLVALYGTNMDIVGSGGSGGSSSMVFTLEDFVGDWRQTAGYNLDQVL
EQGGVSSLFQNLGVSVTPIQRIVLSGENG SEQ ID NO: 475 (CP 55 L27V (RIIbB) (nt sequence)
Atggacatccatgtcatcatcccgtatgaaggtctgagcggcgaccaaatgggccagatcgaaaaaatttttaaggtg
gtgtaccctgtggatgatcatcactttaaggtgatcctgcactatggcacactggtaatcgacggggttacgccgaac
atgatcgactatttcggacggccgtatgaaggcatcgccgtgttcgacggcaaaaagatcactgtaacagggaccctg
tggaacggcaacaaaattatcgacgagcgcctgatcaaccccgacggctccctgctgttccgagtaaccatcaacgga
gtgaccggctggcggctgtGCGAACGCATTCTGGCtAGCTCAAGCGGAGGTTCAGGCGGTTCCGGAATGTATGAAAGC
TTTATTGAGTCACTGCCATTCCTTAAATCTTTGGAGTTTTCTGCACGCCTGAAAGTAGTAGATGTGATAGGCACCAAA -continued

SEQUENCE LISTING

GTATACAACGATGGAGAACAAATCATTGCTCAGGGAGATTCGGCTGATTCTTTTTTCATTATTGAATCTGGAGAAGTG
AAAATTACTATGAAAAGAAAGGGTAAATCAGAAGTGGAAGAGAATGGTGCAGTAGAAATCGCTCGATGCTCGCGGGGA
CAGTACTTTGGAGAGCTTGCCCTGGTAACTAACAAACCTCGAGCAGCTTCTGCCCACGCCATTGGGACTGTCAAATGT
TTAGCAATGGATGTGCAAGCATTTGAAAGGCTTCTGGGACCTTGCATGGAAATTATGAAAAGGAACATCGCTACCTAT
GAAGAACAGTTAGTTGCCCTGTATGGAACGAACATGGATATTGTAGGGTCAGGTGGATCTGGAGGTAGCTCTTCTatg
gtcttcacactcgaagatttcgttggggactggcgacagacagccggctacaacctggaccaagtccttgaacaggga
ggtgtgtccagtttgtttcagaatctcggggtgtccgtaactccgatccaaaggattgtcctgagcggtgaaaatggg
ctgaagatc SEQ ID NO: 476 (CP 55 L27V (RIIbB) (aa seq)
MDIHVIIPYEGLSGDQMGQIEKIFKVVYPVDDHHFKVILHYGTLVIDGVTPNMIDYFGRPYEGIAVFDGKKITVTGTL
WNGNKIIDERLINPDGSLLFRVTINGVTGWRLCERILASSSGGSGGSGMYESFIESLPFLKSLEFSARLKVVDVIGTK
VYNDGEQIIAQGDSADSFFIIESGEVKITMKRKGKSEVEENGAVEIARCSRGQYFGELALVTNKPRAASAHAIGTVKC
LAMDVQAFERLLGPCMEIMKRNIATYEEQLVALYGTNMDIVGSGGSGGSSSMVFTLEDFVGDWRQTAGYNLDQVLEQG
GVSSLFQNLGVSVTPIQRIVLSGENGLKI SEQ ID NO: 477 (CP 83 L27V (RIIbB) (nt sequence)
ATGgtggatgatcatcactttaaggtgatcctgcactatggcacactggtaatcgacggggttacgccgaacatgatc
gactatttcggacggccgtatgaaggcatcgccgtgttcgacggcaaaaagatcactgtaacagggaccctgtggaac
ggcaacaaaattatcgacgagcgcctgatcaaccccgacggctccctgctgttccgagtaaccatcaacggagtgacc
ggctggcggctgtGCGAACGCATTCTGGCtAGCTCAAGCGGAGGTTCAGGCGGTTCCGGAATGTATGAAAGCTTTATT
GAGTCACTGCCATTCCTTAAATCTTTGGAGTTTTCTGCACGCCTGAAAGTAGTAGATGTGATAGGCACCAAAGTATAC
AACGATGGAGAACAAATCATTGCTCAGGGAGATTCGGCTGATTCTTTTTTCATTATTGAATCTGGAGAAGTGAAAATT
ACTATGAAAAGAAAGGGTAAATCAGAAGTGGAAGAGAATGGTGCAGTAGAAATCGCTCGATGCTCGCGGGGACAGTAC
TTTGGAGAGCTTGCCCTGGTAACTAACAAACCTCGAGCAGCTTCTGCCCACGCCATTGGGACTGTCAAATGTTTAGCA
ATGGATGTGCAAGCATTTGAAAGGCTTCTGGGACCTTGCATGGAAATTATGAAAAGGAACATCGCTACCTATGAAGAA
CAGTTAGTTGCCCTGTATGGAACGAACATGGATATTGTAGGGTCAGGTGGATCTGGAGGTAGCTCTTCTatggtcttc
acactcgaagatttcgttggggactggcgacagacagccggctacaacctggaccaagtccttgaacagggaggtgtg
tccagtttgtttcagaatctcggggtgtccgtaactccgatccaaaggattgtcctgagcggtgaaaatgggctgaag
atcgacatccatgtcatcatcccgtatgaaggtctgagcggcgaccaaatgggccagatcgaaaaaatttttaaggtg
gtgtaccct SEQ ID NO: 478 (CP 83 L27V (RIIbB) (aa seq)
MVDDHHFKVILHYGTLVIDGVTPNMIDYFGRPYEGIAVFDGKKITVTGTLWNGNKIIDERLINPDGSLLFRVTINGVT
GWRLCERILASSSGGSGGSGMYESFIESLPFLKSLEFSARLKVVDVIGTKVYNDGEQIIAQGDSADSFFIIESGEVKI
TMKRKGKSEVEENGAVEIARCSRGQYFGELALVTNKPRAASAHAIGTVKCLAMDVQAFERLLGPCMEIMKRNIATYEE
QLVALYGTNMDIVGSGGSGGSSSMVFTLEDFVGDWRQTAGYNLDQVLEQGGVSSLFQNLGVSVTPIQRIVLSGENGLK
IDIHVIIPYEGLSGDQMGQIEKIFKVVYP SEQ ID NO: 479 (CP 84 L27V (RIIbB) (nt sequence)
atggatgatcatcactttaaggtgatcctgcactatggcacactggtaatcgacggggttacgccgaacatgatcgac
tatttcggacggccgtatgaaggcatcgccgtgttcgacggcaaaaagatcactgtaacagggaccctgtggaacggc
aacaaaattatcgacgagcgcctgatcaaccccgacggctccctgctgttccgagtaaccatcaacggagtgaccggc
tggcggctgtGCGAACGCATTCTGGCtAGCTCAAGCGGAGGTTCAGGCGGTTCCGGAATGTATGAAAGCTTTATTGAG
TCACTGCCATTCCTTAAATCTTTGGAGTTTTCTGCACGCCTGAAAGTAGTAGATGTGATAGGCACCAAAGTATACAAC
GATGGAGAACAAATCATTGCTCAGGGAGATTCGGCTGATTCTTTTTTCATTATTGAATCTGGAGAAGTGAAAATTACT
ATGAAAAGAAAGGGTAAATCAGAAGTGGAAGAGAATGGTGCAGTAGAAATCGCTCGATGCTCGCGGGGACAGTACTTT
GGAGAGCTTGCCCTGGTAACTAACAAACCTCGAGCAGCTTCTGCCCACGCCATTGGGACTGTCAAATGTTTAGCAATG
GATGTGCAAGCATTTGAAAGGCTTCTGGGACCTTGCATGGAAATTATGAAAAGGAACATCGCTACCTATGAAGAACAG
TTAGTTGCCCTGTATGGAACGAACATGGATATTGTAGGGTCAGGTGGATCTGGAGGTAGCTCTTCTatggtcttcaca
ctcgaagatttcgttggggactggcgacagacagccggctacaacctggaccaagtccttgaacagggaggtgtgtcc
agtttgtttcagaatctcggggtgtccgtaactccgatccaaaggattgtcctgagcggtgaaaatgggctgaagatc
gacatccatgtcatcatcccgtatgaaggtctgagcggcgaccaaatgggccagatcgaaaaaatttttaaggtggtg
taccctgtg SEQ ID NO: 480 (CP 84 L27V (RIIbB) (aa seq)
MDDHHFKVILHYGTLVIDGVTPNMIDYFGRPYEGIAVFDGKKITVTGTLWNGNKIIDERLINPDGSLLFRVTINGVTG
WRLCERILASSSGGSGGSGMYESFIESLPFLKSLEFSARLKVVDVIGTKVYNDGEQIIAQGDSADSFFIIESGEVKIT
MKRKGKSEVEENGAVEIARCSRGQYFGELALVTNKPRAASAHAIGTVKCLAMDVQAFERLLGPCMEIMKRNIATYEEQ
LVALYGTNMDIVGSGGSGGSSSMVFTLEDFVGDWRQTAGYNLDQVLEQGGVSSLFQNLGVSVTPIQRIVLSGENGLKI
DIHVIIPYEGLSGDQMGQIEKIFKVVYPV SEQ ID NO: 481 (CP 103 L27V (RIIbB) (nt sequence)
ATGacgccgaacatgatcgactatttcggacggccgtatgaaggcatcgccgtgttcgacggcaaaaagatcactgta
acagggaccctgtggaacggcaacaaaattatcgacgagcgcctgatcaaccccgacggctccctgctgttccgagta
accatcaacggagtgaccggctggcggctgtGCGAACGCATTCTGGCtAGCTCAAGCGGAGGTTCAGGCGGTTCCGGA
ATGTATGAAAGCTTTATTGAGTCACTGCCATTCCTTAAATCTTTGGAGTTTTCTGCACGCCTGAAAGTAGTAGATGTG
ATAGGCACCAAAGTATACAACGATGGAGAACAAATCATTGCTCAGGGAGATTCGGCTGATTCTTTTTTCATTATTGAA
TCTGGAGAAGTGAAAATTACTATGAAAAGAAAGGGTAAATCAGAAGTGGAAGAGAATGGTGCAGTAGAAATCGCTCGA
TGCTCGCGGGGACAGTACTTTGGAGAGCTTGCCCTGGTAACTAACAAACCTCGAGCAGCTTCTGCCCACGCCATTGGG
ACTGTCAAATGTTTAGCAATGGATGTGCAAGCATTTGAAAGGCTTCTGGGACCTTGCATGGAAATTATGAAAAGGAAC
ATCGCTACCTATGAAGAACAGTTAGTTGCCCTGTATGGAACGAACATGGATATTGTAGGGTCAGGTGGATCTGGAGGT
AGCTCTTCTatggtcttcacactcgaagatttcgttggggactggcgacagacagccggctacaacctggaccaagtc
cttgaacagggaggtgtgtccagtttgtttcagaatctcggggtgtccgtaactccgatccaaaggattgtcctgagc
ggtgaaaatgggctgaagatcgacatccatgtcatcatcccgtatgaaggtctgagcggcgaccaaatgggccagatc
gaaaaaatttttaaggtggtgtaccctgtggatgatcatcactttaaggtgatcctgcactatggcacactggtaatc
gacggggtt

SEQUENCE LISTING

```
SEQ ID NO: 482 (CP 103 L27V (RIIbB) (aa seq)
MTPNMIDYFGRPYEGIAVFDGKKITVTGTLWNGNKIIDERLINPDGSLLFRVTINGVTGWRLCERILASSSGGSGGSG
MYESFIESLPFLKSLEFSARLKVVDVIGTKVYNDGEQIIAQGDSADSFFIIESGEVKITMKRKGKSEVEENGAVEIAR
CSRGQYFGELALVTNKPRAASAHAIGTVKCLAMDVQAFERLLGPCMEIMKRNIATYEEQLVALYGTNMDIVGSGGSGG
SSSMVFTLEDFVGDWRQTAGYNLDQVLEQGGVSSLFQNLGVSVTPIQRIVLSGENGLKIDIHVIIPYEGLSGDQMGQI
EKIFKVVYPVDDHHFKVILHYGTLVIDGV SEQ ID NO: 483 (CP 120 L27V (RIIbB) (nt sequence)
ATGttcgacggcaaaaagatcactgtaacagggaccctgtggaacggcaacaaaattatcgacgagcgcctgatcaac
cccgacggctccctgctgttccgagtaaccatcaacggagtgaccggctggcggctgtGCGAACGCATTCTGGCtAGC
TCAAGCGGAGGTTCAGGCGGTTCCGGAATGTATGAAAGCTTTATTGAGTCACTGCCATTCCTTAAATCTTTGGAGTTT
TCTGCACGCCTGAAAGTAGTAGATGTGATAGGCACCAAAGTATACAACGATGGAGAACAAATCATTGCTCAGGGAGAT
TCGGCTGATTCTTTTTTCATTATTGAATCTGGAGAAGTGAAAATTACTATGAAAAGAAAGGGTAAATCAGAAGTGGAA
GAGAATGGTGCAGTAGAAATCGCTCGATGCTCGCGGGGACAGTACTTTGGAGAGCTTGCCCTGGTAACTAACAAACCT
CGAGCAGCTTCTGCCCACGCCATTGGGACTGTCAAATGTTTAGCAATGGATGTGCAAGCATTTGAAAGGCTTCTGGGA
CCTTGCATGGAAATTATGAAAAGGAACATCGCTACCTATGAAGAACAGTTAGTTGCCCTGTATGGAACGAACATGGAT
ATTGTAGGGTCAGGTGGATCTGGAGGTAGCTCTTCTatggtcttcacactcgaagatttcgttggggactggcgacag
acagccggctacaacctggaccaagtccttgaacaggaggtgtgtccagtttgtttcagaatctcggggtgtccgta
actccgatccaaaggattgtcctgagcggtgaaaatgggctgaagatcgacatccatgtcatcatcccgtatgaaggt
ctgagcggcgaccaaatgggccagatcgaaaaaattttttaaggtggtgtaccctgtggatgatcatcactttaaggtg
atcctgcactatggcacactggtaatcgacggggttacgccgaacatgatcgactatttcggacggccgtatgaaggc
atcgccgtg SEQ ID NO: 484 (CP 120 L27V (RIIbB) (aa seq)
MFDGKKITVTGTLWNGNKIIDERLINPDGSLLFRVTINGVTGWRLCERILASSSGGSGGSGMYESFIESLPFLKSLEF
SARLKVVDVIGTKVYNDGEQIIAQGDSADSFFIIESGEVKITMKRKGKSEVEENGAVEIARCSRGQYFGELALVTNKP
RAASAHAIGTVKCLAMDVQAFERLLGPCMEIMKRNIATYEEQLVALYGTNMDIVGSGGSGGSSSMVFTLEDFVGDWRQ
TAGYNLDQVLEQGGVSSLFQNLGVSVTPIQRIVLSGENGLKIDIHVIIPYEGLSGDQMGQIEKIFKVVYPVDDHHFKV
ILHYGTLVIDGVTPNMIDYFGRPYEGIAV SEQ ID NO: 485 (CP 123 L27V (RIIbB) (nt sequence)
ATGaaaaagatcactgtaacagggaccctgtggaacggcaacaaaattatcgacgagcgcctgatcaaccccgacggc
tccctgctgttccgagtaaccatcaacggagtgaccggctggcggctgtGCGAACGCATTCTGGCtAGCTCAAGCGGA
GGTTCAGGCGGTTCCGGAATGTATGAAAGCTTTATTGAGTCACTGCCATTCCTTAAATCTTTGGAGTTTTCTGCACGC
CTGAAAGTAGTAGATGTGATAGGCACCAAAGTATACAACGATGGAGAACAAATCATTGCTCAGGGAGATTCGGCTGAT
TCTTTTTTCATTATTGAATCTGGAGAAGTGAAAATTACTATGAAAAGAAAGGGTAAATCAGAAGTGGAAGAGAATGGT
GCAGTAGAAATCGCTCGATGCTCGCGGGGACAGTACTTTGGAGAGCTTGCCCTGGTAACTAACAAACCTCGAGCAGCT
TCTGCCCACGCCATTGGGACTGTCAAATGTTTAGCAATGGATGTGCAAGCATTTGAAAGGCTTCTGGGACCTTGCATG
GAAATTATGAAAAGGAACATCGCTACCTATGAAGAACAGTTAGTTGCCCTGTATGGAACGAACATGGATATTGTAGGG
TCAGGTGGATCTGGAGGTAGCTCTTCTatggtcttcacactcgaagatttcgttggggactggcgacagacagccggc
tacaacctggaccaagtccttgaacaggaggtgtgtccagtttgtttcagaatctcggggtgtccgtaactccgatc
caaaggattgtcctgagcggtgaaaatgggctgaagatcgacatccatgtcatcatcccgtatgaaggtctgagcggc
gaccaaatgggccagatcgaaaaaattttttaaggtggtgtaccctgtggatgatcatcactttaaggtgatcctgcac
tatggcacactggtaatcgacggggttacgccgaacatgatcgactatttcggacggccgtatgaaggcatcgccgtg
ttcgacggc SEQ ID NO: 486 (CP 123 L27V (RIIbB) (aa seq)
MKKITVTGTLWNGNKIIDERLINPDGSLLFRVTINGVTGWRLCERILASSSGGSGGSGMYESFIESLPFLKSLEFSAR
LKVVDVIGTKVYNDGEQIIAQGDSADSFFIIESGEVKITMKRKGKSEVEENGAVEIARCSRGQYFGELALVTNKPRAA
SAHAIGTVKCLAMDVQAFERLLGPCMEIMKRNIATYEEQLVALYGTNMDIVGSGGSGGSSSMVFTLEDFVGDWRQTAG
YNLDQVLEQGGVSSLFQNLGVSVTPIQRIVLSGENGLKIDIHVIIPYEGLSGDQMGQIEKIFKVVYPVDDHHFKVILH
YGTLVIDGVTPNMIDYFGRPYEGIAVFDG SEQ ID NO: 487 (CP 124 L27V (RIIbB) (nt sequence)
ATGaagatcactgtaacagggaccctgtggaacggcaacaaaattatcgacgagcgcctgatcaaccccgacggctcc
ctgctgttccgagtaaccatcaacggagtgaccggctggcggctgtGCGAACGCATTCTGGCtAGCTCAAGCGGAGGT
TCAGGCGGTTCCGGAATGTATGAAAGCTTTATTGAGTCACTGCCATTCCTTAAATCTTTGGAGTTTTCTGCACGCCTG
AAAGTAGTAGATGTGATAGGCACCAAAGTATACAACGATGGAGAACAAATCATTGCTCAGGGAGATTCGGCTGATTCT
TTTTTCATTATTGAATCTGGAGAAGTGAAAATTACTATGAAAAGAAAGGGTAAATCAGAAGTGGAAGAGAATGGTGCA
GTAGAAATCGCTCGATGCTCGCGGGGACAGTACTTTGGAGAGCTTGCCCTGGTAACTAACAAACCTCGAGCAGCTTCT
GCCCACGCCATTGGGACTGTCAAATGTTTAGCAATGGATGTGCAAGCATTTGAAAGGCTTCTGGGACCTTGCATGGAA
ATTATGAAAAGGAACATCGCTACCTATGAAGAACAGTTAGTTGCCCTGTATGGAACGAACATGGATATTGTAGGGTCA
GGTGGATCTGGAGGTAGCTCTTCTatggtcttcacactcgaagatttcgttggggactggcgacagacagccggctac
aacctggaccaagtccttgaacaggaggtgtgtccagtttgtttcagaatctcggggtgtccgtaactccgatccaa
aggattgtcctgagcggtgaaaatgggctgaagatcgacatccatgtcatcatcccgtatgaaggtctgagcggcgac
caaatgggccagatcgaaaaaattttttaaggtggtgtaccctgtggatgatcatcactttaaggtgatcctgcactat
ggcacactggtaatcgacggggttacgccgaacatgatcgactatttcggacggccgtatgaaggcatcgccgtgttc
gacggcaaa SEQ ID NO: 488 (CP 124 L27V (RIIbB) (aa seq)
MKITVTGTLWNGNKIIDERLINPDGSLLFRVTINGVTGWRLCERILASSSGGSGGSGMYESFIESLPFLKSLEFSARL
KVVDVIGTKVYNDGEQIIAQGDSADSFFIIESGEVKITMKRKGKSEVEENGAVEIARCSRGQYFGELALVTNKPRAAS
AHAIGTVKCLAMDVQAFERLLGPCMEIMKRNIATYEEQLVALYGTNMDIVGSGGSGGSSSMVFTLEDFVGDWRQTAGY
NLDQVLEQGGVSSLFQNLGVSVTPIQRIVLSGENGLKIDIHVIIPYEGLSGDQMGQIEKIFKVVYPVDDHHFKVILHY
GTLVIDGVTPNMIDYFGRPYEGIAVFDGK
```

-continued

```
SEQUENCE LISTING

SEQ ID NO: 489 (CP 125 L27V (RIIbB) (nt sequence)
ATGatcactgtaacagggaccctgtggaacggcaacaaaattatcgacgagcgcctgatcaaccccgacggctccctg
ctgttccgagtaaccatcaacggagtgaccggctggcggctgtGCGAACGCATTCTGGCtAGCTCAAGCGGAGGTTCA
GGCGGTTCCGGAATGTATGAAAGCTTTATTGAGTCACTGCCATTCCTTAAATCTTTGGAGTTTTCTGCACGCCTGAAA
GTAGTAGATGTGATAGGCACCAAAGTATACAACGATGGAGAACAAATCATTGCTCAGGGAGATTCGGCTGATTCTTTT
TTCATTATTGAATCTGGAGAAGTGAAAATTACTATGAAAAGAAAGGGTAAATCAGAAGTGGAAGAGAATGGTGCAGTA
GAAATCGCTCGATGCTCGCGGGGACAGTACTTTGGAGAGCTTGCCCTGGTAACTAACAAACCTCGAGCAGCTTCTGCC
CACGCCATTGGGACTGTCAAATGTTTAGCAATGGATGTGCAAGCATTTGAAAGGCTTCTGGGACCTTGCATGGAAATT
ATGAAAAGGAACATCGCTACCTATGAAGAACAGTTAGTTGCCCTGTATGGAACGAACATGGATATTGTAGGGTCAGGT
GGATCTGGAGGTAGCTCTTCTatggtcttcacactcgaagatttcgttggggactggcgacagacagccggctacaac
ctggaccaagtccttgaacagggaggtgtgtccagtttgtttcagaatctcggggtgtccgtaactccgatccaaagg
attgtcctgagcggtgaaaatgggctgaagatcgacatccatgtcatcatcccgtatgaaggtctgagcggcgaccaa
atgggccagatcgaaaaaattttttaaggtggtgtaccctgtggatgatcatcactttaaggtgatcctgcactatggc
acactggtaatcgacggggttacgccgaacatgatcgactatttcggacggccgtatgaaggcatcgccgtgttcgac
ggcaaaaag SEQ ID NO: 490 (CP 125 L27V (RIIbB) (aa seq)
MITVTGTLWNGNKIIDERLINPDGSLLFRVTINGVTGWRLCERILASSSGGSGGSGMYESFIESLPFLKSLEFSARLK
VVDVIGTKVYNDGEQIIAQGDSADSFFIIESGEVKITMKRKGKSEVEENGAVEIARCSRGQYFGELALVTNKPRAASA
HAIGTVKCLAMDVQAFERLLGPCMEIMKRNIATYEEQLVALYGTNMDIVGSGGSGGSSSMVFTLEDFVGDWRQTAGYN
LDQVLEQGGVSSLFQNLGVSVTPIQRIVLSGENGLKIDIHVIIPYEGLSGDQMGQIEKIFKVVYPVDDHHFKVILHYG
TLVIDGVTPNMIDYFGRPYEGIAVFDGKK SEQ ID NO: 491 (CP 130 L27V (RIIbB) (nt sequence)
ATGaccctgtggaacggcaacaaaattatcgacgagcgcctgatcaaccccgacggctccctgctgttccgagtaacc
atcaacggagtgaccggctggcggctgtGCGAACGCATTCTGGCtAGCTCAAGCGGAGGTTCAGGCGGTTCCGGAATG
TATGAAAGCTTTATTGAGTCACTGCCATTCCTTAAATCTTTGGAGTTTTCTGCACGCCTGAAAGTAGTAGATGTGATA
GGCACCAAAGTATACAACGATGGAGAACAAATCATTGCTCAGGGAGATTCGGCTGATTCTTTTTTCATTATTGAATCT
GGAGAAGTGAAAATTACTATGAAAAGAAAGGGTAAATCAGAAGTGGAAGAGAATGGTGCAGTAGAAATCGCTCGATGC
TCGCGGGGACAGTACTTTGGAGAGCTTGCCCTGGTAACTAACAAACCTCGAGCAGCTTCTGCCCACGCCATTGGGACT
GTCAAATGTTTAGCAATGGATGTGCAAGCATTTGAAAGGCTTCTGGGACCTTGCATGGAAATTATGAAAAGGAACATC
GCTACCTATGAAGAACAGTTAGTTGCCCTGTATGGAACGAACATGGATATTGTAGGGTCAGGTGGATCTGGAGGTAGC
TCTTCTatggtcttcacactcgaagatttcgttggggactggcgacagacagccggctacaacctggaccaagtcctt
gaacagggaggtgtgtccagtttgtttcagaatctcggggtgtccgtaactccgatccaaaggattgtcctgagcggt
gaaaatgggctgaagatcgacatccatgtcatcatcccgtatgaaggtctgagcggcgaccaaatgggccagatcgaa
aaaatttttaaggtggtgtaccctgtggatgatcatcactttaaggtgatcctgcactatggcacactggtaatcgac
ggggttacgccgaacatgatcgactatttcggacggccgtatgaaggcatcgccgtgttcgacggcaaaaagatcact
gtaacaggg SEQ ID NO: 492 (CP 130 L27V (RIIbB) (aa seq)
MTLWNGNKIIDERLINPDGSLLFRVTINGVTGWRLCERILASSSGGSGGSGMYESFIESLPFLKSLEFSARLKVVDVI
GTKVYNDGEQIIAQGDSADSFFIIESGEVKITMKRKGKSEVEENGAVEIARCSRGQYFGELALVTNKPRAASAHAIGT
VKCLAMDVQAFERLLGPCMEIMKRNIATYEEQLVALYGTNMDIVGSGGSGGSSSMVFTLEDFVGDWRQTAGYNLDQVL
EQGGVSSLFQNLGVSVTPIQRIVLSGENGLKIDIHVIIPYEGLSGDQMGQIEKIFKVVYPVDDHHFKVILHYGTLVID
GVTPNMIDYFGRPYEGIAVFDGKKITVTG SEQ ID NO: 493 (CP 145 L27V (RIIbB) (nt sequence)
ATGcccgacggctccctgctgttccgagtaaccatcaacggagtgaccggctggcggctgtGCGAACGCATTCTGGCt
AGCTCAAGCGGAGGTTCAGGCGGTTCCGGAATGTATGAAAGCTTTATTGAGTCACTGCCATTCCTTAAATCTTTGGAG
TTTTCTGCACGCCTGAAAGTAGTAGATGTGATAGGCACCAAAGTATACAACGATGGAGAACAAATCATTGCTCAGGGA
GATTCGGCTGATTCTTTTTTCATTATTGAATCTGGAGAAGTGAAAATTACTATGAAAAGAAAGGGTAAATCAGAAGTG
GAAGAGAATGGTGCAGTAGAAATCGCTCGATGCTCGCGGGGACAGTACTTTGGAGAGCTTGCCCTGGTAACTAACAAA
CCTCGAGCAGCTTCTGCCCACGCCATTGGGACTGTCAAATGTTTAGCAATGGATGTGCAAGCATTTGAAAGGCTTCTG
GGACCTTGCATGGAAATTATGAAAAGGAACATCGCTACCTATGAAGAACAGTTAGTTGCCCTGTATGGAACGAACATG
GATATTGTAGGGTCAGGTGGATCTGGAGGTAGCTCTTCTatggtcttcacactcgaagatttcgttggggactggcga
cagacagccggctacaacctggaccaagtccttgaacagggaggtgtgtccagtttgtttcagaatctcggggtgtcc
gtaactccgatccaaaggattgtcctgagcggtgaaaatgggctgaagatcgacatccatgtcatcatcccgtatgaa
ggtctgagcggcgaccaaatgggccagatcgaaaaaatttttaaggtggtgtaccctgtggatgatcatcactttaag
gtgatcctgcactatggcacactggtaatcgacggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaac SEQ ID NO: 494 (CP 145 L27V (RIIbB) (aa seq)
MPDGSLLFRVTINGVTGWRLCERILASSSGGSGGSGMYESFIESLPFLKSLEFSARLKVVDVIGTKVYNDGEQIIAQG
DSADSFFIIESGEVKITMKRKGKSEVEENGAVEIARCSRGQYFGELALVTNKPRAASAHAIGTVKCLAMDVQAFERLL
GPCMEIMKRNIATYEEQLVALYGTNMDIVGSGGSGGSSSMVFTLEDFVGDWRQTAGYNLDQVLEQGGVSSLFQNLGVS
VTPIQRIVLSGENGLKIDIHVIIPYEGLSGDQMGQIEKIFKVVYPVDDHHFKVILHYGTLVIDGVTPNMIDYFGRPYE
GIAVFDGKKITVTGTLWNGNKIIDERLIN SEQ ID NO: 495 (CP 148 L27V (RIIbB) (nt sequence)
ATGtccctgctgttccgagtaaccatcaacggagtgaccggctggcggctgtGCGAACGCATTCTGGCtAGCTCAAGC
GGAGGTTCAGGCGGTTCCGGAATGTATGAAAGCTTTATTGAGTCACTGCCATTCCTTAAATCTTTGGAGTTTTCTGCA
CGCCTGAAAGTAGTAGATGTGATAGGCACCAAAGTATACAACGATGGAGAACAAATCATTGCTCAGGGAGATTCGGCT
GATTCTTTTTTCATTATTGAATCTGGAGAAGTGAAAATTACTATGAAAAGAAAGGGTAAATCAGAAGTGGAAGAGAAT
GGTGCAGTAGAAATCGCTCGATGCTCGCGGGGACAGTACTTTGGAGAGCTTGCCCTGGTAACTAACAAACCTCGAGCA
GCTTCTGCCCACGCCATTGGGACTGTCAAATGTTTAGCAATGGATGTGCAAGCATTTGAAAGGCTTCTGGGACCTTGC
ATGGAAATTATGAAAAGGAACATCGCTACCTATGAAGAACAGTTAGTTGCCCTGTATGGAACGAACATGGATATTGTA
```

SEQUENCE LISTING

```
GGGTCAGGTGGATCTGGAGGTAGCTCTTCTatggtcttcacactcgaagatttcgttggggactggcgacagacagcc
ggctacaacctggaccaagtccttgaacagggaggtgtgtccagtttgtttcagaatctcggggtgtccgtaactccg
atccaaaggattgtcctgagcggtgaaaatgggctgaagatcgacatccatgtcatcatcccgtatgaaggtctgaag
ggcgaccaaatgggccagatcgaaaaaattttttaaggtggtgtaccctgtggatgatcatcactttaaggtgatcctg
cactatggcacactggtaatcgacggggttacgccgaacatgatcgactatttcggacggccgtatgaaggcatcgcc
gtgttcgacggcaaaaagatcactgtaacagggaccctgtggaacggcaacaaaattatcgacgagcgcctgatcaac
cccgacggc SEQ ID NO: 496 (CP 148 L27V (RIIbB) (aa seq)
MSLLFRVTINGVTGWRLCERILASSSGGSGGSGMYESFIESLPFLKSLEFSARLKVVDVIGTKVYNDGEQIIAQGDSA
DSFFIIESGEVKITMKRKGKSEVEENGAVEIARCSRGQYFGELALVTNKPRAASAHAIGTVKCLAMDVQAFERLLGPC
MEIMKRNIATYEEQLVALYGTNMDIVGSGGSGGSSSMVFTLEDFVGDWRQTAGYNLDQVLEQGGVSSLFQNLGVSVTP
IQRIVLSGENGLKIDIHVIIPYEGLSGDQMGQIEKIFKVVYPVDDHHFKVILHYGTLVIDGVTPNMIDYFGRPYEGIA
VFDGKKITVTGTLWNGNKIIDERLINPDG SEQ ID NO: 497 (CP 157 L27V (RIIbB) (nt sequence)
AtGGGAGTGACCGGCTGGCGGCTGTGCGAACGCATTCTGGCTAGCTCAAGCGGAGGTTCAGGCGGTTCCGGAATGTAT
GAAAGCTTTATTGAGTCACTGCCATTCCTTAAATCTTTGGAGTTTTCTGCACGCCTGAAAGTAGTAGATGTGATAGGC
ACCAAAGTATACAACGATGGAGAACAAATCATTGCTCAGGGAGATTCGGCTGATTCTTTTTTCATTATTGAATCTGGA
GAAGTGAAAATTACTATGAAAAGAAAGGGTAAATCAGAAGTGGAAGAGAATGGTGCAGTAGAAATCGCTCGATGCTCG
CGGGGACAGTACTTTGGAGAGCTTGCCCTGGTAACTAACAAACCTCGAGCAGCTTCTGCCCACGCCATTGGGACTGTC
AAATGTTTAGCAATGGATGTGCAAGCATTTGAAAGGCTTCTGGGACCTTGCATGGAAATTATGAAAAGGAACATCGCT
ACCTATGAAGAACAGTTAGTTGCCCTGTATGGAACGAACATGGATATTGTAGGGTCAGGTGGATCTGGAGGTAGCTCT
TCTATGGTCTTCACACTCGAAGATTTCGTTGGGGACTGGCGACAGACAGCCGGCTACAACCTGGACCAAGTCCTTGAA
CAGGGAGGTGTGTCCAGTTTGTTTCAGAATCTCGGGGTGTCCGTAACTCCGATCCAAAGGATTGTCCTGAGCGGTGAA
AATGGGCTGAAGATCGACATCCATGTCATCATCCCGTATGAAGGTCTGAGCGGCGACCAAATGGGCCAGATCGAAAAA
ATTTTTAAGGTGGTGTACCCTGTGGATGATCATCACTTTAAGGTGATCCTGCACTATGGCACACTGGTAATCGACGGG
GTTACGCCGAACATGATCGACTATTTCGGACGGCCGTATGAAGGCATCGCCGTGTTCGACGGCAAAAAGATCACTGTA
ACAGGGACCCTGTGGAACGGCAACAAAATTATCGACGAGCGCCTGATCAACCCCGACGGCTCCCTGCTGTTCCGAGTA
ACCATCAAC SEQ ID NO: 498 (CP 157 L27V (RIIbB) (aa seq)
MGVTGWRLCERILASSSGGSGGSGMYESFIESLPFLKSLEFSARLKVVDVIGTKVYNDGEQIIAQGDSADSFFIIESG
EVKITMKRKGKSEVEENGAVEIARCSRGQYFGELALVTNKPRAASAHAIGTVKCLAMDVQAFERLLGPCMEIMKRNIA
TYEEQLVALYGTNMDIVGSGGSGGSSSMVFTLEDFVGDWRQTAGYNLDQVLEQGGVSSLFQNLGVSVTPIQRIVLSGE
NGLKIDIHVIIPYEGLSGDQMGQIEKIFKVVYPVDDHHFKVILHYGTLVIDGVTPNMIDYFGRPYEGIAVFDGKKITV
TGTLWNGNKIIDERLINPDGSLLFRVTIN SEQ ID NO: 499 (SS 6 L27V (RIIbB) (nt sequence)
ATGgtcttcacactcgaagatAGCgctAGCGGAGGTTCAGGCGGTTCCGGAatgtatgaaagctttattgagtcactg
ccattccttaaatctttggagttttctgcacgcctgaaagtagtagatgtgataggcaccaaagtatacaacgatgga
gaacaaatcattgctcagggagattcggctgattcttttttcattattgaatctggagaagtgaaaattactatgaaa
agaaagggtaaatcagaagtggaagagaatggtgcagtagaaatcgctcgatgctcgcggggacagtactttggagag
cttgccctggtaactaacaaacctcgagcagcttctgcccacgccattgggactgtcaaatgtttagcaatggatgtg
caagcatttgaaaggcttctgggaccttgcatggaaattatgaaaaggaacatcgctacctatgaagaacagttagtt
gccctgTATggaacgaacatggatattgtaggGTCAGGTGGATCTGGAGGtAGCTCttcTttcgttggggactggcga
cagacagccggctacaacctggaccaagtccttgaacagggaggtgtgtccagtttgtttcagaatctcggggtgtcc
gtaactccgatccaaaggattgtcctgagcggtgaaaatgggctgaagatcgacatccatgtcatcatcccgtatgaa
ggtctgagcggcgaccaaatgggccagatcgaaaaaattttttaaggtggtgtaccctgtggatgatcatcactttaag
gtgatcctgcactatggcacactggtaatcgacggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 500 (SS 6 L27V (RIIbB) (aa seq)
MVFTLEDSASGGSGGSGMYESFIESLPFLKSLEFSARLKVVDVIGTKVYNDGEQIIAQGDSADSFFIIESGEVKITMK
RKGKSEVEENGAVEIARCSRGQYFGELALVTNKPRAASAHAIGTVKCLAMDVQAFERLLGPCMEIMKRNIATYEEQLV
ALYGTNMDIVGSGGSGGSSSFVGDWRQTAGYNLDQVLEQGGVSSLFQNLGVSVTPIQRIVLSGENGLKIDIHVIIPYE
GLSGDQMGQIEKIFKVVYPVDDHHFKVILHYGTLVIDGVTPNMIDYFGRPYEGIAVFDGKKITVTGTLWNGNKIIDER
LINPDGSLLFRVTINGVTGWRLCERILA SEQ ID NO: 501 (SS 12 L27V (RIIbB) (nt sequence)
ATGgtcttcacactcgaagatttcgttggggactggcgaAGCgctAGCGGAGGTTCAGGCGGTTCCGGAatgtatgaa
agctttattgagtcactgccattccttaaatctttggagttttctgcacgcctgaaagtagtagatgtgataggcacc
aaagtatacaacgatggagaacaaatcattgctcagggagattcggctgattcttttttcattattgaatctggagaa
gtgaaaattactatgaaaagaaagggtaaatcagaagtggaagagaatggtgcagtagaaatcgctcgatgctcgcgg
ggacagtactttggagagcttgccctggtaactaacaaacctcgagcagcttctgcccacgccattgggactgtcaaa
tgtttagcaatggatgtgcaagcatttgaaaggcttctgggaccttgcatggaaattatgaaaaggaacatcgctacc
tatgaagaacagttagttgccctgTATggaacgaacatggatattgtaggGTCAGGTGGATCTGGAGGtAGCTCttcT
cagacagccggctacaacctggaccaagtccttgaacagggaggtgtgtccagtttgtttcagaatctcggggtgtcc
gtaactccgatccaaaggattgtcctgagcggtgaaaatgggctgaagatcgacatccatgtcatcatcccgtatgaa
ggtctgagcggcgaccaaatgggccagatcgaaaaaattttttaaggtggtgtaccctgtggatgatcatcactttaag
gtgatcctgcactatggcacactggtaatcgacggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt
```

SEQUENCE LISTING

SEQ ID NO: 502 (SS 12 L27V (RIIbB) (aa seq)
MVFTLEDFVGDWRSASGGSGGSGMYESFIESLPFLKSLEFSARLKVVDVIGTKVYNDGEQIIAQGDSADSFFIIESGE
VKITMKRKGKSEVEENGAVEIARCSRGQYFGELALVTNKPRAASAHAIGTVKCLAMDVQAFERLLGPCMEIMKRNIAT
YEEQLVALYGTNMDIVGSGGSGGSSSQTAGYNLDQVLEQGGVSSLFQNLGVSVTPIQRIVLSGENGLKIDIHVIIPYE
GLSGDQMGQIEKIFKVVYPVDDHHFKVILHYGTLVIDGVTPNMIDYFGRPYEGIAVFDGKKITVTGTLWNGNKIIDER
LINPDGSLLFRVTINGVTGWRLCERILA SEQ ID NO: 503 (SS 26 L27V (RIIbB) (nt sequence)
ATGgtcttcacactcgaagatttcgttggggactggcgacagacagccggctacaacctggaccaagtccttgaacag
ggaAGCgctAGCGGAGGTTCAGGCGGTTCCGGAatgtatgaaagctttattgagtcactgccattccttaaatctttg
gagttttctgcacgcctgaaagtagtagatgtgataggcaccaaagtatacaacgatggagaacaaatcattgctcag
ggagattcggctgattctttttcattattgaatctggagaagtgaaaattactatgaaaagaaagggtaaatcagaa
gtggaagagaatggtgcagtagaaatcgctcgatgctcgcggggacagtactttggagagcttgccctggtaactaac
aaacctcgagcagcttctgcccacgccattgggactgtcaaatgtttagcaatggatgtgcaagcatttgaaaggctt
ctgggaccttgcatggaaattatgaaaaggaacatcgctacctatgaagaacagttagttgccctgTATggaacgaac
atggatattgtaggGTCAGGTGGATCTGGAGGtAGCTCttcTggtgtgtccagtttgtttcagaatctcggggtgtcc
gtaactccgatccaaaggattgtcctgagcggtgaaaatgggctgaagatcgacatccatgtcatcatcccgtatgaa
ggtctgagcggcgaccaaatgggccagatcgaaaaaattttttaaggtggtgtaccctgtggatgatcatcactttaag
gtgatcctgcactatgcacactggtaatcgacggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 504 (SS 26 L27V (RIIbB) (aa seq)
MVFTLEDFVGDWRQTAGYNLDQVLEQGSASGGSGGSGMYESFIESLPFLKSLEFSARLKVVDVIGTKVYNDGEQIIAQ
GDSADSFFIIESGEVKITMKRKGKSEVEENGAVEIARCSRGQYFGELALVTNKPRAASAHAIGTVKCLAMDVQAFERL
LGPCMEIMKRNIATYEEQLVALYGTNMDIVGSGGSGGSSSGVSSLFQNLGVSVTPIQRIVLSGENGLKIDIHVIIPYE
GLSGDQMGQIEKIFKVVYPVDDHHFKVILHYGTLVIDGVTPNMIDYFGRPYEGIAVFDGKKITVTGTLWNGNKIIDER
LINPDGSLLFRVTINGVTGWRLCERILA SEQ ID NO: 505 (SS 45 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcAGCgctAGC
GGCGGTTCCGGAatgtatgaaagctttattgagtcactgccattccttaaatctttggagttttctgcacgcctgaaa
gtagtagatgtgataggcaccaaagtatacaacgatggagaacaaatcattgctcagggagattcggctgattctttt
ttcattattgaatctggagaagtgaaaattactatgaaaagaaagggtaaatcagaagtggaagagaatggtgcagta
gaaatcgctcgatgctcgcggggacagtactttggagagcttgccctggtaactaacaaacctcgagcagcttctgcc
cacgccattgggactgtcaaatgtttagcaatggatgtgcaagcatttgaaaggcttctgggaccttgcatggaaatt
atgaaaaggaacatcgctacctatgaagaacagttagttgccctgTATggaacgaacatggatattgtaggGTCAGGT
GGATCTGGAGGtAGCTCttcTgtcctgagcggtgaaaatgggctgaagatcgacatccatgtcatcatcccgtatgaa
ggtctgagcggcgaccaaatgggccagatcgaaaaaattttttaaggtggtgtaccctgtggatgatcatcactttaag
gtgatcctgcactatgcacactggtaatcgacggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 506 (SS 45 L27V (RIIbB) (aa seq)
MVFTLEDFVGDWRQTAGYNLDQVLEQGGVSSLFQNLGVSVTPIQRISASGGSGGSGMYESFIESLPFLKSLEFSARLK
VVDVIGTKVYNDGEQIIAQGDSADSFFIIESGEVKITMKRKGKSEVEENGAVEIARCSRGQYFGELALVTNKPRAASA
HAIGTVKCLAMDVQAFERLLGPCMEIMKRNIATYEEQLVALYGTNMDIVGSGGSGGSSSVLSGENGLKIDIHVIIPYE
GLSGDQMGQIEKIFKVVYPVDDHHFKVILHYGTLVIDGVTPNMIDYFGRPYEGIAVFDGKKITVTGTLWNGNKIIDER
LINPDGSLLFRVTINGVTGWRLCERILA SEQ ID NO: 507 (SS 48 L27V (RIIbB) (nt sequence)
atggtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcAGCgctAGC
GGAGGTTCAGGCGGTTCCGGAatgtatgaaagctttattgagtcactgccattccttaaatctttggagttttctgca
cgcctgaaagtagtagatgtgataggcaccaaagtatacaacgatggagaacaaatcattgctcagggagattcggct
gattctttttcattattgaatctggagaagtgaaaattactatgaaaagaaagggtaaatcagaagtggaagagaat
ggtgcagtagaaatcgctcgatgctcgcggggacagtactttggagagcttgccctggtaactaacaaacctcgagca
gcttctgcccacgccattgggactgtcaaatgtttagcaatggatgtgcaagcatttgaaaggcttctgggaccttgc
atggaaattatgaaaaggaacatcgctacctatgaagaacagttagttgccctgTATggaacgaacatggatattgta
ggGTCAGGTGGATCTGGAGGtAGCTCttcTggtgaaaatgggctgaagatcgacatccatgtcatcatcccgtatgaa
ggtctgagcggcgaccaaatgggccagatcgaaaaaattttttaaggtggtgtaccctgtggatgatcatcactttaag
gtgatcctgcactatggcacactggtaatcgacggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 508 (SS 48 L27V (RIIbB) (aa seq)
MVFTLEDFVGDWRQTAGYNLDQVLEQGGVSSLFQNLGVSVTPIQRIVLSSASGGSGGSGMYESFIESLPFLKSLEFSA
RLKVVDVIGTKVYNDGEQIIAQGDSADSFFIIESGEVKITMKRKGKSEVEENGAVEIARCSRGQYFGELALVTNKPRA
ASAHAIGTVKCLAMDVQAFERLLGPCMEIMKRNIATYEEQLVALYGTNMDIVGSGGSGGSSSGENGLKIDIHVIIPYE
GLSGDQMGQIEKIFKVVYPVDDHHFKVILHYGTLVIDGVTPNMIDYFGRPYEGIAVFDGKKITVTGTLWNGNKIIDER
LINPDGSLLFRVTINGVTGWRLCERILA

SEQUENCE LISTING

SEQ ID NO: 509 (SS 52 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggAGCgctAGCGGAGGTTCAGGCGGTTCCGGAatgtatgaaagctttattgagtcactgccattccttaaatctttg
gagttttctgcacgcctgaaagtagtagatgtgataggcaccaaagtatacaacgatggagaacaaatcattgctcag
ggagattcggctgattcttttttcattattgaatctggagaagtgaaaattactatgaaaagaaagggtaaatcagaa
gtggaagagaatggtgcagtagaaatcgctcgatgctcgcggggacagtactttggagagcttgccctggtaactaac
aaacctcgagcagcttctgcccacgccattgggactgtcaaatgtttagcaatggatgtgcaagcatttgaaaggctt
ctgggaccttgcatggaaattatgaaaaggaacatcgctacctatgaagaacagttagttgccctgTATggaacgaac
atggatattgtaggGTCAGGTGGATCTGGAGGtAGCTCttcTctgaagatcgacatccatgtcatcatcccgtatgaa
ggtctgagcggcgaccaaatgggccagatcgaaaaaattttttaaggtggtgtacccctgtggatgatcatcactttaag
gtgatcctgcactatggcacactggtaatcgacggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 510 (SS 52 L27V (RIIbB) (aa seq)
MVFTLEDFVGDWRQTAGYNLDQVLEQGGVSSLFQNLGVSVTPIQRIVLSGENGSASGGSGGSGMYESFIESLPFLKSL
EFSARLKVVDVIGTKVYNDGEQIIAQGDSADSFFIIESGEVKITMKRKGKSEVEENGAVEIARCSRGQYFGELALVTN
KPRAASAHAIGTVKCLAMDVQAFERLLGPCMEIMKRNIATYEEQLVALYGTNMDIVGSGGSGGSSSLKIDIHVIIPYE
GLSGDQMGQIEKIFKVVYPVDDHHFKVILHYGTLVIDGVTPNMIDYFGRPYEGIAVFDGKKITVTGTLWNGNKIIDER
LINPDGSLLFRVTINGVTGWRLCERILA SEQ ID NO: 511 (SS 55 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcAGCgctAGCGGAGGTTCAGGCGGTTCCGGAatgtatgaaagctttattgagtcactgccattcctt
aaatctttggagttttctgcacgcctgaaagtagtagatgtgataggcaccaaagtatacaacgatggagaacaaatc
attgctcagggagattcggctgattcttttttcattattgaatctggagaagtgaaaattactatgaaaagaaagggt
aaatcagaagtggaagagaatggtgcagtagaaatcgctcgatgctcgcggggacagtactttggagagcttgccctg
gtaactaacaaacctcgagcagcttctgcccacgccattgggactgtcaaatgtttagcaatggatgtgcaagcattt
gaaaggcttctgggaccttgcatggaaattatgaaaaggaacatcgctacctatgaagaacagttagttgccctgTAT
ggaacgaacatggatattgtaggGTCAGGTGGATCTGGAGGtAGCTCttcTgacatccatgtcatcatcccgtatgaa
ggtctgagcggcgaccaaatgggccagatcgaaaaaattttttaaggtggtgtacccctgtggatgatcatcactttaag
gtgatcctgcactatggcacactggtaatcgacggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 512 (SS 55 L27V (RIIbB) (aa seq)
MVFTLEDFVGDWRQTAGYNLDQVLEQGGVSSLFQNLGVSVTPIQRIVLSGENGLKISASGGSGGSGMYESFIESLPFL
KSLEFSARLKVVDVIGTKVYNDGEQIIAQGDSADSFFIIESGEVKITMKRKGKSEVEENGAVEIARCSRGQYFGELAL
VTNKPRAASAHAIGTVKCLAMDVQAFERLLGPCMEIMKRNIATYEEQLVALYGTNMDIVGSGGSGGSSSDIHVIIPYE
GLSGDQMGQIEKIFKVVYPVDDHHFKVILHYGTLVIDGVTPNMIDYFGRPYEGIAVFDGKKITVTGTLWNGNKIIDER
LINPDGSLLFRVTINGVTGWRLCERILA SEQ ID NO: 513 (SS 83 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctAGCgctAGCGGAGGTTCAGGCGGTTCCGGAatgtatgaaagctttattgagtcactgcca
ttccttaaatctttggagttttctgcacgcctgaaagtagtagatgtgataggcaccaaagtatacaacgatggagaa
caaatcattgctcagggagattcggctgattcttttttcattattgaatctggagaagtgaaaattactatgaaaaga
aagggtaaatcagaagtggaagagaatggtgcagtagaaatcgctcgatgctcgcggggacagtactttggagagctt
gccctggtaactaacaaacctcgagcagcttctgcccacgccattgggactgtcaaatgtttagcaatggatgtgcaa
gcatttgaaaggcttctgggaccttgcatggaaattatgaaaaggaacatcgctacctatgaagaacagttagttgcc
ctgTATggaacgaacatggatattgtaggGTCAGGTGGATCTGGAGGtAGCTCttcTgtggatgatcatcactttaag
gtgatcctgcactatggcacactggtaatcgacggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 514 (SS 83 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPSASGGSGGSGMYESFIESLPFLKSLEFSARLKVVDVIGTKVYNDGEQIIAQGDSADSFFIIESGEVKITMKR
KGKSEVEENGAVEIARCSRGQYFGELALVTNKPRAASAHAIGTVKCLAMDVQAFERLLGPCMEIMKRNIATYEEQLVA
LYGTNMDIVGSGGSGGSSVDDHHFKVILHYGTLVIDGVTPNMIDYFGRPYEGIAVFDGKKITVTGTLWNGNKIIDER
LINPDGSLLFRVTINGVTGWRLCERILA SEQ ID NO: 515 (SS 84 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtgAGCgctAGCGGAGGTTCAGGCGGTTCCGGAatgtatgaaagctttattgagtcactg
ccattccttaaatctttggagttttctgcacgcctgaaagtagtagatgtgataggcaccaaagtatacaacgatgga
gaacaaatcattgctcagggagattcggctgattcttttttcattattgaatctggagaagtgaaaattactatgaaa -continued

SEQUENCE LISTING agaaagggtaaatcagaagtggaagagaatggtgcagtagaaatcgctcgatgctcgcggggacagtactttggagag
cttgccctggtaactaacaaacctcgagcagcttctgcccacgccattgggactgtcaaatgtttagcaatggatgtg
caagcatttgaaaggcttctgggaccttgcatggaaattatgaaaaggaacatcgctacctatgaagaacagttagtt
gccctgTATggaacgaacatggatattgtaggGTCAGGTGGATCTGGAGGtAGCTCttcTgatgatcatcactttaag
gtgatcctgcactatggcacactggtaatcgacggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 516 (SS 84 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVSASGGSGGSGMYESFIESLPFLKSLEFSARLKVVDVIGTKVYNDGEQIIAQGDSADSFFIIESGEVKITMK
RKGKSEVEENGAVEIARCSRGQYFGELALVTNKPRAASAHAIGTVKCLAMDVQAFERLLGPCMEIMKRNIATYEEQLV
ALYGTNMDIVGSGGSGGSSSDDHHFKVILHYGTLVIDGVTPNMIDYFGRPYEGIAVFDGKKITVTGTLWNGNKIIDER
LINPDGSLLFRVTINGVTGWRLCERILA SEQ ID NO: 517 (SS 85 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatAGCgctAGCGGAGGTTCAGGCGGTTCCGGAatgtatgaaagctttattgagtca
ctgccattccttaaatctttggagttttctgcacgcctgaaagtagtagatgtgataggcaccaaagtatacaacgat
ggagaacaaatcattgctcagggagattcggctgattctttttttcattattgaatctggagaagtgaaaattactatg
aaaagaaagggtaaatcagaagtggaagagaatggtgcagtagaaatcgctcgatgctcgcggggacagtactttgga
gagcttgccctggtaactaacaaacctcgagcagcttctgcccacgccattgggactgtcaaatgtttagcaatggat
gtgcaagcatttgaaaggcttctgggaccttgcatggaaattatgaaaaggaacatcgctacctatgaagaacagtta
gttgccctgTATggaacgaacatggatattgtaggGTCAGGTGGATCTGGAGGtAGCTCttcTgatcatcactttaag
gtgatcctgcactatggcacactggtaatcgacggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 518 (SS 85 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDSASGGSGGSGMYESFIESLPFLKSLEFSARLKVVDVIGTKVYNDGEQIIAQGDSADSFFIIESGEVKITM
KRKGKSEVEENGAVEIARCSRGQYFGELALVTNKPRAASAHAIGTVKCLAMDVQAFERLLGPCMEIMKRNIATYEEQL
VALYGTNMDIVGSGGSGGSSSDHHFKVILHYGTLVIDGVTPNMIDYFGRPYEGIAVFDGKKITVTGTLWNGNKIIDER
LINPDGSLLFRVTINGVTGWRLCERILA SEQ ID NO: 519 (SS 100 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcAGCgctAGC
GGAGGTTCAGGCGGTTCCGGAatgtatgaaagctttattgagtcactgccattccttaaatctttggagttttctgca
cgcctgaaagtagtagatgtgataggcaccaaagtatacaacgatggagaacaaatcattgctcagggagattcggct
gattctttttttcattattgaatctggagaagtgaaaattactatgaaaagaaagggtaaatcagaagtggaagagaat
ggtgcagtagaaatcgctcgatgctcgcggggacagtactttggagagcttgccctggtaactaacaaacctcgagca
gcttctgcccacgccattgggactgtcaaatgtttagcaatggatgtgcaagcatttgaaaggcttctgggaccttgc
atggaaattatgaaaaggaacatcgctacctatgaagaacagttagttgccctgTATggaacgaacatggatattgta
ggGTCAGGTGGATCTGGAGGtAGCTCttcTgacggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 520 (SS 100 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVISASGGSGGSGMYESFIESLPFLKSLEFSARLKVVDVIGTKVYNDGEQIIAQGDSA
DSFFIIESGEVKITMKRKGKSEVEENGAVEIARCSRGQYFGELALVTNKPRAASAHAIGTVKCLAMDVQAFERLLGPC
MEIMKRNIATYEEQLVALYGTNMDIVGSGGSGGSSSDGVTPNMIDYFGRPYEGIAVFDGKKITVTGTLWNGNKIIDER
LINPDGSLLFRVTINGVTGWRLCERILA SEQ ID NO: 521 (SS 101 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacAGCgct
AGCGGAGGTTCAGGCGGTTCCGGAatgtatgaaagctttattgagtcactgccattccttaaatctttggagttttct
gcacgcctgaaagtagtagatgtgataggcaccaaagtatacaacgatggagaacaaatcattgctcagggagattcg
gctgattctttttttcattattgaatctggagaagtgaaaattactatgaaaagaaagggtaaatcagaagtggaagag
aatggtgcagtagaaatcgctcgatgctcgcggggacagtactttggagagcttgccctggtaactaacaaacctcga
gcagcttctgcccacgccattgggactgtcaaatgtttagcaatggatgtgcaagcatttgaaaggcttctgggacct
tgcatggaaattatgaaaaggaacatcgctacctatgaagaacagttagttgccctgTATggaacgaacatggatatt
gtaggGTCAGGTGGATCTGGAGGtAGCTCttcTggggttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt

SEQUENCE LISTING

SEQ ID NO: 522 (SS 101 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDSASGGSGGSGMYESFIESLPFLKSLEFSARLKVVDVIGTKVYNDGEQIIAQGDS
ADSFFIIESGEVKITMKRKGKSEVEENGAVEIARCSRGQYFGELALVTNKPRAASAHAIGTVKCLAMDVQAFERLLGP
CMEIMKRNIATYEEQLVALYGTNMDIVGSGGSGGSSSGVTPNMIDYFGRPYEGIAVFDGKKITVTGTLWNGNKIIDER
LINPDGSLLFRVTINGVTGWRLCERILA SEQ ID NO: 523 (SS 102 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacgggAGC
gctAGCGGAGGTTCAGGCGGTTCCGGAatgtatgaaagctttattgagtcactgccattccttaaatctttggagttt
tctgcacgcctgaaagtagtagatgtgataggcaccaaagtatacaacgatggagaacaaatcattgctcagggagat
tcggctgattctttttttcattattgaatctggagaagtgaaaattactatgaaaagaaagggtaaatcagaagtggaa
gagaatggtgcagtagaaatcgctcgatgctcgcggggacagtactttggagagcttgccctggtaactaacaaacct
cgagcagcttctgcccacgccattgggactgtcaaatgtttagcaatggatgtgcaagcatttgaaaggcttctggga
ccttgcatggaaattatgaaaggaacatcgctacctatgaagaacagttagttgccctgTATggaacgaacatggat
attgtaggGTCAGGTGGATCTGGAGGtAGCTCttcTgttacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 524 (SS 102 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGSASGGSGGSGMYESFIESLPFLKSLEFSARLKVVDVIGTKVYNDGEQIIAQGD
SADSFFIIESGEVKITMKRKGKSEVEENGAVEIARCSRGQYFGELALVTNKPRAASAHAIGTVKCLAMDVQAFERLLG
PCMEIMKRNIATYEEQLVALYGTNMDIVGSGGSGGSSSVTPNMIDYFGRPYEGIAVFDGKKITVTGTLWNGNKIIDER
LINPDGSLLFRVTINGVTGWRLCERILA SEQ ID NO: 525 (SS 103 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
AGCgctAGCGGAGGTTCAGGCGGTTCCGGAatgtatgaaagctttattgagtcactgccattccttaaatctttggag
ttttctgcacgcctgaaagtagtagatgtgataggcaccaaagtatacaacgatggagaacaaatcattgctcaggga
gattcggctgattcttttttcattattgaatctggagaagtgaaaattactatgaaaagaaagggtaaatcagaagtg
gaagagaatggtgcagtagaaatcgctcgatgctcgcggggacagtactttggagagcttgccctggtaactaacaaa
cctcgagcagcttctgcccacgccattgggactgtcaaatgtttagcaatggatgtgcaagcatttgaaaggcttctg
ggaccttgcatggaaattatgaaaggaacatcgctacctatgaagaacagttagttgccctgTATggaacgaacatg
gatattgtaggGTCAGGTGGATCTGGAGGtAGCTCttcTacgccgaacatgatcgactatttcggacggccgtatgaa
ggcatcgccgtgttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 526 (SS 103 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVSASGGSGGSGMYESFIESLPFLKSLEFSARLKVVDVIGTKVYNDGEQIIAQG
DSADSFFIIESGEVKITMKRKGKSEVEENGAVEIARCSRGQYFGELALVTNKPRAASAHAIGTVKCLAMDVQAFERLL
GPCMEIMKRNIATYEEQLVALYGTNMDIVGSGGSGGSSSTPNMIDYFGRPYEGIAVFDGKKITVTGTLWNGNKIIDER
LINPDGSLLFRVTINGVTGWRLCERILA SEQ ID NO: 527 (SS 120 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgAGCgctAGCGGAGGTTCAGGCGGTTCC
GGAatgtatgaaagctttattgagtcactgccattccttaaatctttggagttttctgcacgcctgaaagtagtagat
gtgataggcaccaaagtatacaacgatggagaacaaatcattgctcagggagattcggctgattcttttttcattatt
gaatctggagaagtgaaaattactatgaaaagaaagggtaaatcagaagtggaagagaatggtgcagtagaaatcgct
cgatgctcgcggggacagtactttggagagcttgccctggtaactaacaaacctcgagcagcttctgcccacgccatt
gggactgtcaaatgtttagcaatggatgtgcaagcatttgaaaggcttctgggaccttgcatggaaattatgaaagg
aacatcgctacctatgaagaacagttagttgccctgTATggaacgaacatggatattgtaggGTCAGGTGGATCTGGA
GGtAGCTCttcTttcgacggcaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 528 (SS 120 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVSASGGSGGSGMYESFIESLPFLKSLEFSARLKVVD
VIGTKVYNDGEQIIAQGDSADSFFIIESGEVKITMKRKGKSEVEENGAVEIARCSRGQYFGELALVTNKPRAASAHAI
GTVKCLAMDVQAFERLLGPCMEIMKRNIATYEEQLVALYGTNMDIVGSGGSGGSSSFDGKKITVTGTLWNGNKIIDER
LINPDGSLLFRVTINGVTGWRLCERILA

SEQUENCE LISTING

SEQ ID NO: 529 (SS 123 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcAGCgctAGCGGAGGTTCA
GGCGGTTCCGGAatgtatgaaagcttttattgagtcactgccattccttaaatctttggagttttctgcacgcctgaaa
gtagtagatgtgataggcaccaaagtatacaacgatggagaacaaatcattgctcagggagattcggctgattcttttt
ttcattattgaatctggagaagtgaaaattactatgaaaagaaagggtaaatcagaagtggaagagaatggtgcagta
gaaatcgctcgatgctcgcggggacagtactttggagagcttgccctggtaactaacaaacctcgagcagcttctgcc
cacgccatgggactgtcaaatgtttagcaatggatgtgcaagcatttgaaaggcttctgggaccttgcatggaaatt
atgaaaaggaacatcgctacctatgaagaacagttagttgccctgTATggaacgaacatggatattgtaggGTCAGGT
GGATCTGGAGGtAGCTCttcTaaaaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 530 (SS 123 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGSASGGSGGSGMYESFIESLPFLKSLEFSARLK
VVDVIGTKVYNDGEQIIAQGDSADSFFIIESGEVKITMKRKGKSEVEENGAVEIARCSRGQYFGELALVTNKPRAASA
HAIGTVKCLAMDVQAFERLLGPCMEIMKRNIATYEEQLVALYGTNMDIVGSGGSGGSSKKITVTGTLWNGNKIIDER
LINPDGSLLFRVTINGVTGWRLCERILA SEQ ID NO: 531 (SS 124 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaAGCgctAGCGGAGGT
TCAGGCGGTTCCGGAatgtatgaaagcttttattgagtcactgccattccttaaatctttggagttttctgcacgcctg
aaagtagtagatgtgataggcaccaaagtatacaacgatggagaacaaatcattgctcagggagattcggctgattct
tttttcattattgaatctggagaagtgaaaattactatgaaaagaaagggtaaatcagaagtggaagagaatggtgca
gtagaaatcgctcgatgctcgcggggacagtactttggagagcttgccctggtaactaacaaacctcgagcagcttct
gcccacgccattgggactgtcaaatgtttagcaatggatgtgcaagcatttgaaaggcttctgggaccttgcatggaa
attatgaaaaggaacatcgctacctatgaagaacagttagttgccctgTATggaacgaacatggatattgtaggGTCA
GGTGGATCTGGAGGtAGCTCttcTaagatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 532 (SS 124 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKSASGGSGGSGMYESFIESLPFLKSLEFSARL
KVVDVIGTKVYNDGEQIIAQGDSADSFFIIESGEVKITMKRKGKSEVEENGAVEIARCSRGQYFGELALVTNKPRAAS
AHAIGTVKCLAMDVQAFERLLGPCMEIMKRNIATYEEQLVALYGTNMDIVGSGGSGGSSKITVTGTLWNGNKIIDER
LINPDGSLLFRVTINGVTGWRLCERILA SEQ ID NO: 533 (SS 125 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagAGCgctAGCGGA
GGTTCAGGCGGTTCCGGAatgtatgaaagcttttattgagtcactgccattccttaaatctttggagttttctgcacgc
ctgaaagtagtagatgtgataggcaccaaagtatacaacgatggagaacaaatcattgctcagggagattcggctgat
tcttttttcattattgaatctggagaagtgaaaattactatgaaaagaaagggtaaatcagaagtggaagagaatggt
gcagtagaaatcgctcgatgctcgcggggacagtactttggagagcttgccctggtaactaacaaacctcgagcagct
tctgcccacgccattgggactgtcaaatgtttagcaatggatgtgcaagcatttgaaaggcttctgggaccttgcatg
gaaattatgaaaaggaacatcgctacctatgaagaacagttagttgccctgTATggaacgaacatggatattgtaggG
TCAGGTGGATCTGGAGGtAGCTCttcTatcactgtaacagggaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 534 (SS 125 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKSASGGSGGSGMYESFIESLPFLKSLEFSAR
LKVVDVIGTKVYNDGEQIIAQGDSADSFFIIESGEVKITMKRKGKSEVEENGAVEIARCSRGQYFGELALVTNKPRAA
SAHAIGTVKCLAMDVQAFERLLGPCMEIMKRNIATYEEQLVALYGTNMDIVGSGGSGGSSSITVTGTLWNGNKIIDER
LINPDGSLLFRVTINGVTGWRLCERILA SEQ ID NO: 535 (SS 130 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggAGCgctAGCGGAGGTTCAGGCGGTTCCGGAatgtatgaaagcttttattgagtcactgccattccttaaatctttg
gagttttctgcacgcctgaaagtagtagatgtgataggcaccaaagtatacaacgatggagaacaaatcattgctcag

SEQUENCE LISTING

```
ggagattcggctgattcttttttcattattgaatctggagaagtgaaaattactatgaaaagaaagggtaaatcagaa
gtggaagagaatggtgcagtagaaatcgctcgatgctcgcggggacagtactttggagagcttgccctggtaactaac
aaacctcgagcagcttctgcccacgccattgggactgtcaaatgtttagcaatggatgtgcaagcatttgaaaggctt
ctgggacccttgcatggaaattatgaaaaggaacatcgctacctatgaagaacagttagttgccctgTATggaacgaac
atggatattgtaggGTCAGGTGGATCTGGAGGtAGCTCttcTaccctgtggaacggcaacaaaattatcgacgagcgc
ctgatcaaccccgacggctccctgctgttccgagtaaccatcaacggagtgaccggctggcggctgtGCGAACGCATT
CTGGCt SEQ ID NO: 536 (SS 130 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGSASGGSGGSGMYESFIESLPFLKSL
EFSARLKVVDVIGTKVYNDGEQIIAQGDSADSFFIIESGEVKITMKRKGKSEVEENGAVEIARCSRGQYFGELALVTN
KPRAASAHAIGTVKCLAMDVQAFERLLGPCMEIMKRNIATYEEQLVALYGTNMDIVGSGGSGGSSSTLWNGNKIIDER
LINPDGSLLFRVTINGVTGWRLCERILA SEQ ID NO: 537 (SS 136 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggaccctgtggaacggcaacAGCgctAGCGGAGGTTCAGGCGGTTCCGGAatgtatgaaagctttattgagtcactg
ccattccttaaatctttggagttttctgcacgcctgaaagtagtagatgtgataggcaccaaagtatacaacgatgga
gaacaaatcattgctcagggagattcggctgattcttttttcattattgaatctggagaagtgaaaattactatgaaa
agaaagggtaaatcagaagtggaagagaatggtgcagtagaaatcgctcgatgctcgcggggacagtactttggagag
cttgccctggtaactaacaaacctcgagcagcttctgcccacgccattgggactgtcaaatgtttagcaatggatgtg
caagcatttgaaaggcttctgggacccttgcatggaaattatgaaaaggaacatcgctacctatgaagaacagttagtt
gccctgTATggaacgaacatggatattgtaggGTCAGGTGGATCTGGAGGtAGCTCttcTaaaattatcgacgagcgc
ctgatcaaccccgacggctccctgctgttccgagtaaccatcaacggagtgaccggctggcggctgtGCGAACGCATT
CTGGCt SEQ ID NO: 538 (SS 136 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNSASGGSGGSGMYESFIESL
PFLKSLEFSARLKVVDVIGTKVYNDGEQIIAQGDSADSFFIIESGEVKITMKRKGKSEVEENGAVEIARCSRGQYFGE
LALVTNKPRAASAHAIGTVKCLAMDVQAFERLLGPCMEIMKRNIATYEEQLVALYGTNMDIVGSGGSGGSSSKIIDER
LINPDGSLLFRVTINGVTGWRLCERILA SEQ ID NO: 539 (SS 143 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggaccctgtggaacggcaacaaaattatcgacgagcgcctgAGCgctAGCGGAGGTTCAGGCGGTTCCGGAtgtat
gaaagctttattgagtcactgccattccttaaatctttggagttttctgcacgcctgaaagtagtagatgtgataggc
accaaagtatacaacgatggagaacaaatcattgctcagggagattcggctgattcttttttcattattgaatctgga
gaagtgaaaattactatgaaaagaaagggtaaatcagaagtggaagagaatggtgcagtagaaatcgctcgatgctcg
cggggacagtactttggagagcttgccctggtaactaacaaacctcgagcagcttctgcccacgccattgggactgtc
aaatgtttagcaatggatgtgcaagcatttgaaaggcttctgggacccttgcatggaaattatgaaaaggaacatcgct
acctatgaagaacagttagttgccctgTATggaacgaacatggatattgtaggGTCAGGTGGATCTGGAGGtAGCTCt
tcTatcaaccccgacggctccctgctgttccgagtaaccatcaacggagtgaccggctggcggctgtGCGAACGCATT
CTGGCt SEQ ID NO: 540 (SS 143 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLSASGSGGSGMY
ESFIESLPFLKSLEFSARLKVVDVIGTKVYNDGEQIIAQGDSADSFFIIESGEVKITMKRKGKSEVEENGAVEIARCS
RGQYFGELALVTNKPRAASAHAIGTVKCLAMDVQAFERLLGPCMEIMKRNIATYEEQLVALYGTNMDIVGSGGSGGSS
SINPDGSLLFRVTINGVTGWRLCERILA SEQ ID NO: 541 (SS 145 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggaccctgtggaacggcaacaaaattatcgacgagcgcctgatcaacAGCgctAGCGGAGGTTCAGGCGGTTCCGGA
atgtatgaaagctttattgagtcactgccattccttaaatctttggagttttctgcacgcctgaaagtagtagatgtg
ataggcaccaaagtatacaacgatggagaacaaatcattgctcagggagattcggctgattcttttttcattattgaa
tctggagaagtgaaaattactatgaaaagaaagggtaaatcagaagtggaagagaatggtgcagtagaaatcgctcga
tgctcgcggggacagtactttggagagcttgccctggtaactaacaaacctcgagcagcttctgcccacgccattggg
actgtcaaatgtttagcaatggatgtgcaagcatttgaaaggcttctgggacccttgcatggaaattatgaaaaggaac
atcgctacctatgaagaacagttagttgccctgTATggaacgaacatggatattgtaggGTCAGGTGGATCTGGAGGt
AGCTCttcTcccgacggctccctgctgttccgagtaaccatcaacggagtgaccggctggcggctgtGCGAACGCATT
CTGGCt
```

SEQUENCE LISTING

SEQ ID NO: 542 (SS 145 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINSASGSGGSG
MYESFIESLPFLKSLEFSARLKVVDVIGTKVYNDGEQIIAQGDSADSFFIIESGEVKITMKRKGKSEVEENGAVEIAR
CSRGQYFGELALVTNKPRAASAHAIGTVKCLAMDVQAFERLLGPCMEIMKRNIATYEEQLVALYGTNMDIVGSGGSGG
SSSPDGSLLFRVTINGVTGWRLCERILA SEQ ID NO: 543 (SS 147 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggaccctgtggaacggcaacaaaattatcgacgagcgcctgatcaaccccgacAGCgctAGCGGAGGTTCAGGCGGT
TCCGGAatgtatgaaagctttattgagtcactgccattccttaaatctttggagttttctgcacgcctgaaagtagta
gatgtgataggcaccaaagtatacaacgatggagaacaaatcattgctcagggagattcggctgattcttttttcatt
attgaatctggagaagtgaaaattactatgaaaagaaagggtaaatcagaagtggaagagaatggtgcagtagaaatc
gctcgatgctcgcggggacagtactttggagagcttgccctggtaactaacaaacctcgagcagcttctgcccacgcc
attgggactgtcaaatgtttagcaatggatgtgcaagcatttgaaaggcttctgggaccttgcatggaaattatgaaa
aggaacatcgctacctatgaagaacagttagttgccctgTATggaacgaacatggatattgtaggGTCAGGTGGATCT
GGAGGtAGCTCttcTggctccctgctgttccgagtaaccatcaacggagtgaccggctggcggctgtGCGAACGCATT
CTGGCt SEQ ID NO: 544 (SS 147 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINPDSASGGSGG
SGMYESFIESLPFLKSLEFSARLKVVDVIGTKVYNDGEQIIAQGDSADSFFIIESGEVKITMKRKGKSEVEENGAVEI
ARCSRGQYFGELALVTNKPRAASAHAIGTVKCLAMDVQAFERLLGPCMEIMKRNIATYEEQLVALYGTNMDIVGSGGS
GGGSSSGSLLFRVTINGVTGWRLCERILA SEQ ID NO: 545 (SS 148 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggaccctgtggaacggcaacaaaattatcgacgagcgcctgatcaaccccgacggcAGCgctAGCGGAGGTTCAGGC
GGTTCCGGAatgtatgaaagctttattgagtcactgccattccttaaatctttggagttttctgcacgcctgaaagta
gtagatgtgataggcaccaaagtatacaacgatggagaacaaatcattgctcagggagattcggctgattctttttc
attattgaatctggagaagtgaaaattactatgaaaagaaagggtaaatcagaagtggaagagaatggtgcagtagaa
atcgctcgatgctcgcggggacagtactttggagagcttgccctggtaactaacaaacctcgagcagcttctgcccac
gccattgggactgtcaaatgtttagcaatggatgtgcaagcatttgaaaggcttctgggaccttgcatggaaattatg
aaaaggaacatcgctacctatgaagaacagttagttgccctgTATggaacgaacatggatattgtaggGTCAGGTGGA
TCTGGAGGtAGCTCttcTtccctgctgttccgagtaaccatcaacggagtgaccggctggcggctgtGCGAACGCATT
CTGGCt SEQ ID NO: 546 (SS 148 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINPDGSASGGSG
GSGMYESFIESLPFLKSLEFSARLKVVDVIGTKVYNDGEQIIAQGDSADSFFIIESGEVKITMKRKGKSEVEENGAVE
IARCSRGQYFGELALVTNKPRAASAHAIGTVKCLAMDVQAFERLLGPCMEIMKRNIATYEEQLVALYGTNMDIVGSGG
SGGGSSSSLLFRVTINGVTGWRLCERILA SEQ ID NO: 547 (SS 156 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggaccctgtggaacggcaacaaaattatcgacgagcgcctgatcaaccccgacggctcctgctgttccgagtaacc
atcAGCgctAGCGGAGGTTCAGGCGGTTCCGGAatgtatgaaagctttattgagtcactgccattccttaaatctttg
gagttttctgcacgcctgaaagtagtagatgtgataggcaccaaagtatacaacgatggagaacaaatcattgctcag
ggagattcggctgattcttttttcattattgaatctggagaagtgaaaattactatgaaaagaaagggtaaatcagaa
gtggaagagaatggtgcagtagaaatcgctcgatgctcgcggggacagtactttggagagcttgccctggtaactaac
aaacctcgagcagcttctgcccacgccattgggactgtcaaatgtttagcaatggatgtgcaagcatttgaaaggctt
ctgggaccttgcatggaaattatgaaaaggaacatcgctacctatgaagaacagttagttgccctgTATggaacgaac
atggatattgtaggGTCAGGTGGATCTGGAGGtAGCTCttcTaacggagtgaccggctggcggctgtGCGAACGCATT
CTGGCt SEQ ID NO: 548 (SS 156 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINPDGSLLFRVT
ISASGGSGGSGMYESFIESLPFLKSLEFSARLKVVDVIGTKVYNDGEQIIAQGDSADSFFIIESGEVKITMKRKGKSE
VEENGAVEIARCSRGQYFGELALVTNKPRAASAHAIGTVKCLAMDVQAFERLLGPCMEIMKRNIATYEEQLVALYGTN
MDIVGSGGSGGSSNGVTGWRLCERILA

SEQUENCE LISTING

SEQ ID NO: 549 (SS 157 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggaccctgtggaacggcaacaaaattatcgacgagcgcctgatcaaccccgacggctcccctgctgttccgagtaacc
atcaacAGCgctAGCGGAGGTTCAGGCGGTTCCGGAatgtatgaaagctttattgagtcactgccattccttaaatct
ttggagttttctgcacgcctgaaagtagtagatgtgataggcaccaaagtatacaacgatggagaacaaatcattgct
cagggagattcggctgattcttttttcattattgaatctggagaagtgaaaattactatgaaaagaaagggtaaatca
gaagtggaagagaatggtgcagtagaaatcgctcgatgctcgcggggacagtactttggagagcttgccctggtaact
aacaaacctcgagcagcttctgcccacgccattgggactgtcaaatgtttagcaatggatgtgcaagcatttgaaagg
cttctgggaccttgcatggaaattatgaaaaggaacatcgctacctatgaagaacagttagttgccctgTATggaacg
aacatggatattgtaggGTCAGGTGGATCTGGAGGtAGCTCttcTggagtgaccggctggcggctgtGCGAACGCATT
CTGGCt SEQ ID NO: 550 (SS 157 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINPDGSLLFRVT
INSASGGSGGSGMYESFIESLPFLKSLEFSARLKVVDVIGTKVYNDGEQIIAQGDSADSFFIIESGEVKITMKRKGKS
EVEENGAVEIARCSRGQYFGELALVTNKPRAASAHAIGTVKCLAMDVQAFERLLGPCMEIMKRNIATYEEQLVALYGT
NMDIVGSGGSGGSSSGVTGWRLCERILA SEQ ID NO: 551 (SS 158 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggaccctgtggaacggcaacaaaattatcgacgagcgcctgatcaaccccgacggctcccctgctgttccgagtaacc
atcaacggaAGCgctAGCGGAGGTTCAGGCGGTTCCGGAatgtatgaaagctttattgagtcactgccattccttaaa
tctttggagttttctgcacgcctgaaagtagtagatgtgataggcaccaaagtatacaacgatggagaacaaatcatt
gctcagggagattcggctgattcttttttcattattgaatctggagaagtgaaaattactatgaaaagaaagggtaaa
tcagaagtggaagagaatggtgcagtagaaatcgctcgatgctcgcggggacagtactttggagagcttgccctggta
actaacaaacctcgagcagcttctgcccacgccattgggactgtcaaatgtttagcaatggatgtgcaagcatttgaa
aggcttctgggaccttgcatggaaattatgaaaaggaacatcgctacctatgaagaacagttagttgccctgTATgga
acgaacatggatattgtaggGTCAGGTGGATCTGGAGGtAGCTCttcTgtgaccggctggcggctgtGCGAACGCATT
CTGGCt SEQ ID NO: 552 (SS 158 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINPDGSLLFRVT
INGSASGGSGGSGMYESFIESLPFLKSLEFSARLKVVDVIGTKVYNDGEQIIAQGDSADSFFIIESGEVKITMKRKGK
SEVEENGAVEIARCSRGQYFGELALVTNKPRAASAHAIGTVKCLAMDVQAFERLLGPCMEIMKRNIATYEEQLVALYG
TNMDIVGSGGSGGSSSVTGWRLCERILA SEQ ID NO: 553 (SS 166 L27V (RIIbB) (nt sequence)
ATGgtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggaccctgtggaacggcaacaaaattatcgacgagcgcctgatcaaccccgacggctcccctgctgttccgagtaacc
atcaacggagtgaccggctggcggctgtGCGAAAGCgctAGCGGAGGTTCAGGCGGTTCCGGAatgtatgaaagcttt
attgagtcactgccattccttaaatctttggagttttctgcacgcctgaaagtagtagatgtgataggcaccaaagta
tacaacgatggagaacaaatcattgctcagggagattcggctgattcttttttcattattgaatctggagaagtgaaa
attactatgaaaagaaagggtaaatcagaagtggaagagaatggtgcagtagaaatcgctcgatgctcgcggggacag
tactttggagagcttgccctggtaactaacaaacctcgagcagcttctgcccacgccattgggactgtcaaatgttta
gcaatggatgtgcaagcatttgaaaggcttctgggaccttgcatggaaattatgaaaaggaacatcgctacctatgaa
gaacagttagttgccctgTATggaacgaacatggatattgtaggGTCAGGTGGATCTGGAGGtAGCTCttcTCGCATT
CTGGCt SEQ ID NO: 554 (SS 166 L27V (RIIbB) (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCESASGGSGGSGMYESFIESLPFLKSLEFSARLKVVDVIGTKVYNDGEQIIAQGDSADSFFIIESGEVK
ITMKRKGKSEVEENGAVEIARCSRGQYFGELALVTNKPRAASAHAIGTVKCLAMDVQAFERLLGPCMEIMKRNIATYE
EQLVALYGTNMDIVGSGGSGGSSSRILA SEQ ID NO: 555 (CP 26 L27V (RIIbB) (nt sequence)
ATGggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggaccctgtggaacggcaacaaaattatcgacgagcgcctgatcaaccccgacggctcccctgctgttccgagtaacc
atcaacggagtgaccggctggcggctgtGCGAACGCATTCTGGCtAGCTCAAGCGGAGGTTCAGGCGGTTCCGGAATG

SEQUENCE LISTING

```
TATGAAAGCTTTATTGAGTCACTGCCATTCCTTAAATCTTTGGAGTTTTCTGCACGCCTGAAAGTAGTAGATGTGATA
GGCACCAAAGTATACAACGATGGAGAACAAATCATTGCTCAGGGAGATTCGGCTGATTCTTTTTTCATTATTGAATCT
GGAGAAGTGAAAATTACTATGAAAAGAAAGGGTAAATCAGAAGTGGAAGAGAATGGTGCAGTAGAAATCGCTCGATGC
TCGCGGGGACAGTACTTTGGAGAGCTTGCCCTGGTAACTAACAAACCTCGAGCAGCTTCTGCCCACGCCATTGGGACT
GTCAAATGTTTAGCAATGGATGTGCAAGCATTTGAAAGGCTTCTGGGACCTTGCATGGAAATTATGAAAAGGAACATC
GCTACCTATGAAGAACAGTTAGTTGCCCTGTATGAACGAACATGGATATTGTAGGGTCAGGTGGATCTGGAGGTAGC
TCTTCTatggtcttcacactcgaagatttcgttggggactggcgacagacagccggctacaacctggaccaagtcctt
gaacaggga SEQ ID NO: 556 (CP 26 L27V (RIIbB) (aa seq)
MGVSSLFQNLGVSVTPIQRIVLSGENGLKIDIHVIIPYEGLSGDQMGQIEKIFKVVYPVDDHHFKVILHYGTLVIDGV
TPNMIDYFGRPYEGIAVFDGKKITVTGTLWNGNKIIDERLINPDGSLLFRVTINGVTGWRLCERILASSSGGSGGSGM
YESFIESLPFLKSLEFSARLKVVDVIGTKVYNDGEQIIAQGDSADSFFIIESGEVKITMKRKGKSEVEENGAVEIARC
SRGQYFGELALVTNKPRAASAHAIGTVKCLAMDVQAFERLLGPCMEIMKRNIATYEEQLVALYGTNMDIVGSGGSGGS
SSMVFTLEDFVGDWRQTAGYNLDQVLEQG SEQ ID NO: 557 (CP 45 L27V (RIIbB) (nt sequence)
ATGgtcctgagcggtgaaaatgggctgaagatcgacatccatgtcatcatcccgtatgaaggtctgagcggcgaccaa
atgggccagatcgaaaaaattttttaaggtggtgtaccctgtggatgatcatcactttaaggtgatcctgcactatggc
acactggtaatcgacggggttacgccgaacatgatcgactatttcggacggccgtatgaaggcatcgccgtgttcgac
ggcaaaaagatcactgtaacagggaccctgtggaacggcaacaaaattatcgacgagcgcctgatcaaccccgacggc
tccctgctgttccgagtaaccatcaacggagtgaccggctggcggctgtGCGAACGCATTCTGGCtAGCTCAAGCGGA
GGTTCAGGCGGTTCCGGAATGTATGAAAGCTTTATTGAGTCACTGCCATTCCTTAAATCTTTGGAGTTTTCTGCACGC
CTGAAAGTAGTAGATGTGATAGGCACCAAAGTATACAACGATGGAGAACAAATCATTGCTCAGGGAGATTCGGCTGAT
TCTTTTTTCATTATTGAATCTGGAGAAGTGAAAATTACTATGAAAAGAAAGGGTAAATCAGAAGTGGAAGAGAATGGT
GCAGTAGAAATCGCTCGATGCTCGCGGGGACAGTACTTTGGAGAGCTTGCCCTGGTAACTAACAAACCTCGAGCAGCT
TCTGCCCACGCCATTGGGACTGTCAAATGTTTAGCAATGGATGTGCAAGCATTTGAAAGGCTTCTGGGACCTTGCATG
GAAATTATGAAAAGGAACATCGCTACCTATGAAGAACAGTTAGTTGCCCTGTATGAACGAACATGGATATTGTAGGG
TCAGGTGGATCTGGAGGTAGCTCTTCTatggtcttcacactcgaagatttcgttggggactggcgacagacagccggc
tacaacctggaccaagtccttgaacagggaggtgtgtccagtttgtttcagaatctcggggtgtccgtaactccgatc
caaaggatt SEQ ID NO: 558 (CP 45 L27V (RIIbB) (aa seq)
MVLSGENGLKIDIHVIIPYEGLSGDQMGQIEKIFKVVYPVDDHHFKVILHYGTLVIDGVTPNMIDYFGRPYEGIAVFD
GKKITVTGTLWNGNKIIDERLINPDGSLLFRVTINGVTGWRLCERILASSSGGSGGSGMYESFIESLPFLKSLEFSAR
LKVVDVIGTKVYNDGEQIIAQGDSADSFFIIESGEVKITMKRKGKSEVEENGAVEIARCSRGQYFGELALVTNKPRAA
SAHAIGTVKCLAMDVQAFERLLGPCMEIMKRNIATYEEQLVALYGTNMDIVGSGGSGGSSSMVFTLEDFVGDWRQTAG
YNLDQVLEQGGVSSLFQNLGVSVTPIQRI SEQ ID NO: 559 (CP 100(+1) L27V (RIIbB) (nt sequence)
ATGgacggggttacgccgaacatgatcgactatttcggacggccgtatgaaggcatcgccgtgttcgacggcaaaaag
atcactgtaacagggaccctgtggaacggcaacaaaattatcgacgagcgcctgatcaaccccgacggctccctgctg
ttccgagtaaccatcaacggagtgaccggctggcggctgtGCGAACGCATTCTGGCtAGCTCAAGCGGAGGTTCAGGC
GGTTCCGGAATGTATGAAAGCTTTATTGAGTCACTGCCATTCCTTAAATCTTTGGAGTTTTCTGCACGCCTGAAAGTA
GTAGATGTGATAGGCACCAAAGTATACAACGATGGAGAACAAATCATTGCTCAGGGAGATTCGGCTGATTCTTTTTTC
ATTATTGAATCTGGAGAAGTGAAAATTACTATGAAAAGAAAGGGTAAATCAGAAGTGGAAGAGAATGGTGCAGTAGAA
ATCGCTCGATGCTCGCGGGGACAGTACTTTGGAGAGCTTGCCCTGGTAACTAACAAACCTCGAGCAGCTTCTGCCCAC
GCCATTGGGACTGTCAAATGTTTAGCAATGGATGTGCAAGCATTTGAAAGGCTTCTGGGACCTTGCATGGAAATTATG
AAAAGGAACATCGCTACCTATGAAGAACAGTTAGTTGCCCTGTATGAACGAACATGGATATTGTAGGGTCAGGTGGA
TCTGGAGGTAGCTCTTCTatggtcttcacactcgaagatttcgttggggactggcgacagacagccggctacaacctg
gaccaagtccttgaacagggaggtgtgtccagtttgtttcagaatctcggggtgtccgtaactccgatcaaaggatt
gtcctgagcggtgaaaatgggctgaagatcgacatccatgtcatcatcccgtatgaaggtctgagcggcgaccaaatg
ggccagatcgaaaaaattttttaaggtggtgtaccctgtggatgatcatcactttaaggtgatcctgcactatggcaca
ctggtaatcGAC SEQ ID NO: 560 (CP 100(+1) L27V (RIIbB) (aa seq)
MDGVTPNMIDYFGRPYEGIAVFDGKKITVTGTLWNGNKIIDERLINPDGSLLFRVTINGVTGWRLCERILASSSGGSG
GSGMYESFIESLPFLKSLEFSARLKVVDVIGTKVYNDGEQIIAQGDSADSFFIIESGEVKITMKRKGKSEVEENGAVE
IARCSRGQYFGELALVTNKPRAASAHAIGTVKCLAMDVQAFERLLGPCMEIMKRNIATYEEQLVALYGTNMDIVGSGG
SGGSSSMVFTLEDFVGDWRQTAGYNLDQVLEQGGVSSLFQNLGVSVTPIQRIVLSGENGLKIDIHVIIPYEGLSGDQM
GQIEKIFKVVYPVDDHHFKVILHYGTLVID SEQ ID NO: 561 (CP 101(+1) L27V (RIIbB) (nt sequence)
ATGggggttacgccgaacatgatcgactatttcggacggccgtatgaaggcatcgccgtgttcgacggcaaaaagatc
actgtaacagggaccctgtggaacggcaacaaaattatcgacgagcgcctgatcaaccccgacggctccctgctgttc
cgagtaaccatcaacggagtgaccggctggcggctgtGCGAACGCATTCTGGCtAGCTCAAGCGGAGGTTCAGGCGGT
TCCGGAATGTATGAAAGCTTTATTGAGTCACTGCCATTCCTTAAATCTTTGGAGTTTTCTGCACGCCTGAAAGTAGTA
GATGTGATAGGCACCAAAGTATACAACGATGGAGAACAAATCATTGCTCAGGGAGATTCGGCTGATTCTTTTTTCATT
ATTGAATCTGGAGAAGTGAAAATTACTATGAAAAGAAAGGGTAAATCAGAAGTGGAAGAGAATGGTGCAGTAGAAATC
GCTCGATGCTCGCGGGGACAGTACTTTGGAGAGCTTGCCCTGGTAACTAACAAACCTCGAGCAGCTTCTGCCCACGCC
ATTGGGACTGTCAAATGTTTAGCAATGGATGTGCAAGCATTTGAAAGGCTTCTGGGACCTTGCATGGAAATTATGAAA
AGGAACATCGCTACCTATGAAGAACAGTTAGTTGCCCTGTATGAACGAACATGGATATTGTAGGGTCAGGTGGATCT
GGAGGTAGCTCTTCTatggtcttcacactcgaagatttcgttggggactggcgacagacagccggctacaacctggac
caagtccttgaacagggaggtgtgtccagtttgtttcagaatctcggggtgtccgtaactccgatcaaaggattgtc
ctgagcggtgaaaatgggctgaagatcgacatccatgtcatcatcccgtatgaaggtctgagcggcgaccaaatgggc
cagatcgaaaaaattttttaaggtggtgtaccctgtggatgatcatcactttaaggtgatcctgcactatggcacactg
gtaatcgacGGG
```

SEQUENCE LISTING

```
SEQ ID NO: 562 (CP 101(+1) L27V (RIIbB) (aa seq)
MGVTPNMIDYFGRPYEGIAVFDGKKITVTGTLWNGNKIIDERLINPDGSLLFRVTINGVTGWRLCERILASSSGGSGG
SGMYESFIESLPFLKSLEFSARLKVVDVIGTKVYNDGEQIIAQGDSADSFFIIESGEVKITMKRKGKSEVEENGAVEI
ARCSRGQYFGELALVTNKPRAASAHAIGTVKCLAMDVQAFERLLGPCMEIMKRNIATYEEQLVALYGTNMDIVGSGGS
GGSSSMVFTLEDFVGDWRQTAGYNLDQVLEQGGVSSLFQNLGVSVTPIQRIVLSGENGLKIDIHVIIPYEGLSGDQMG
QIEKIFKVVYPVDDHHFKVILHYGTLVIDG SEQ ID NO: 563 (CP 102(+1) L27V (RIIbB) (nt sequence)
ATGgttacgccgaacatgatcgactatttcggacggccgtatgaaggcatcgccgtgttcgacggcaaaaagatcact
gtaacagggacccgtgtggaacggcaacaaaattatcgacgagcgcctgatcaaccccgacggctccctgctgttccga
gtaaccatcaacggagtgaccggctggcggctgtGCGAACGCATTCTGGCtAGCTCAAGCGGAGGTTCAGGCGGTTCC
GGAATGTATGAAAGCTTTATTGAGTCACTGCCATTCCTTAAATCTTTGGAGTTTTCTGCACGCCTGAAAGTAGTAGAT
GTGATAGGCACCAAAGTATACAACGATGGAGAACAAATCATTGCTCAGGGAGATTCGGCTGATTCTTTTTTCATTATT
GAATCTGGAGAAGTGAAAATTACTATGAAAAGAAAGGGTAAATCAGAAGTGGAAGAGAATGGTGCAGTAGAAATCGCT
CGATGCTCGCGGGGACAGTACTTTGGAGAGCTTGCCCTGGTAACTAACAAACCTCGAGCAGCTTCTGCCCACGCCATT
GGGACTGTCAAATGTTTAGCAATGGATGTGCAAGCATTTGAAAGGCTTCTGGGACCTTGCATGGAAATTATGAAAAGG
AACATCGCTACCTATGAAGAACAGTTAGTTGCCCTGTATGGAACGAACATGGATATTGTAGGGTCAGGTGGATCTGGA
GGTAGCTCTTCTatggtcttcacactcgaagatttcgttggggactggcgacagacagccggctacaacctggaccaa
gtccttgaacagggaggtgtgtccagtttgtttcagaatctcggggtgtccgtaactccgatccaaaggattgtcctg
agcggtgaaaatgggctgaagatcgacatccatgtcatcatcccgtatgaaggtctgagcggcgaccaaatgggccag
atcgaaaaaattttttaaggtggtgtaccctgtggatgatcatcactttaaggtgatcctgcactatggcacactggta
atcgacgggGTT SEQ ID NO: 564 (CP 102(+1) L27V (RIIbB) (aa seq)
MVTPNMIDYFGRPYEGIAVFDGKKITVTGTLWNGNKIIDERLINPDGSLLFRVTINGVTGWRLCERILASSSGGSGGS
GMYESFIESLPFLKSLEFSARLKVVDVIGTKVYNDGEQIIAQGDSADSFFIIESGEVKITMKRKGKSEVEENGAVEIA
RCSRGQYFGELALVTNKPRAASAHAIGTVKCLAMDVQAFERLLGPCMEIMKRNIATYEEQLVALYGTNMDIVGSGGSG
GSSSMVFTLEDFVGDWRQTAGYNLDQVLEQGGVSSLFQNLGVSVTPIQRIVLSGENGLKIDIHVIIPYEGLSGDQMGQ
IEKIFKVVYPVDDHHFKVILHYGTLVIDGV SEQ ID NO: 565 (CP 143(+1) L27V (RIIbB) (nt sequence)
ATGatcaaccccgacggctccctgctgttccgagtaaccatcaacggagtgaccggctggcggctgtGCGAACGCATT
CTGGCtAGCTCAAGCGGAGGTTCAGGCGGTTCCGGAATGTATGAAAGCTTTATTGAGTCACTGCCATTCCTTAAATCT
TTGGAGTTTTCTGCACGCCTGAAAGTAGTAGATGTGATAGGCACCAAAGTATACAACGATGGAGAACAAATCATTGCT
CAGGGAGATTCGGCTGATTCTTTTTTCATTATTGAATCTGGAGAAGTGAAAATTACTATGAAAAGAAAGGGTAAATCA
GAAGTGGAAGAGAATGGTGCAGTAGAAATCGCTCGATGCTCGCGGGGACAGTACTTTGGAGAGCTTGCCCTGGTAACT
AACAAACCTCGAGCAGCTTCTGCCCACGCCATTGGGACTGTCAAATGTTTAGCAATGGATGTGCAAGCATTTGAAAGG
CTTCTGGGACCTTGCATGGAAATTATGAAAAGGAACATCGCTACCTATGAAGAACAGTTAGTTGCCCTGTATGGAACG
AACATGGATATTGTAGGGTCAGGTGGATCTGGAGGTAGCTCTTCTatggtcttcacactcgaagatttcgttggggac
tggcgacagacagccggctacaacctggaccaagtccttgaacagggaggtgtgtccagtttgtttcagaatctcggg
gtgtccgtaactccgatccaaaggattgtcctgagcggtgaaaatgggctgaagatcgacatccatgtcatcatcccg
tatgaaggtctgagcggcgaccaaatgggccagatcgaaaaaattttttaaggtggtgtaccctgtggatgatcatcac
tttaaggtgatcctgcactatggcacactggtaatcgacggggttacgccgaacatgatcgactatttcggacggccg
tatgaaggcatcgccgtgttcgacggcaaaaagatcactgtaacagggacccgtgtggaacggcaacaaaattatcgac
gagcgcctgATC SEQ ID NO: 566 (CP 143(+1) L27V (RIIbB) (aa seq)
MINPDGSLLFRVTINGVTGWRLCERILASSSGGSGGSGMYESFIESLPFLKSLEFSARLKVVDVIGTKVYNDGEQIIA
QGDSADSFFIIESGEVKITMKRKGKSEVEENGAVEIARCSRGQYFGELALVTNKPRAASAHAIGTVKCLAMDVQAFER
LLGPCMEIMKRNIATYEEQLVALYGTNMDIVGSGGSGGSSSMVFTLEDFVGDWRQTAGYNLDQVLEQGGVSSLFQNLG
VSVTPIQRIVLSGENGLKIDIHVIIPYEGLSGDQMGQIEKIFKVVYPVDDHHFKVILHYGTLVIDGVTPNMIDYFGRP
YEGIAVFDGKKITVTGTLWNGNKIIDERLI SEQ ID NO: 567 (CP 147(+1) L27V (RIIbB) (nt sequence)
ATGggctccctgctgttccgagtaaccatcaacggagtgaccggctggcggctgtGCGAACGCATTCTGGCtAGCTCA
AGCGGAGGTTCAGGCGGTTCCGGAATGTATGAAAGCTTTATTGAGTCACTGCCATTCCTTAAATCTTTGGAGTTTTCT
GCACGCCTGAAAGTAGTAGATGTGATAGGCACCAAAGTATACAACGATGGAGAACAAATCATTGCTCAGGGAGATTCG
GCTGATTCTTTTTTCATTATTGAATCTGGAGAAGTGAAAATTACTATGAAAAGAAAGGGTAAATCAGAAGTGGAAGAG
AATGGTGCAGTAGAAATCGCTCGATGCTCGCGGGGACAGTACTTTGGAGAGCTTGCCCTGGTAACTAACAAACCTCGA
GCAGCTTCTGCCCACGCCATTGGGACTGTCAAATGTTTAGCAATGGATGTGCAAGCATTTGAAAGGCTTCTGGGACCT
TGCATGGAAATTATGAAAAGGAACATCGCTACCTATGAAGAACAGTTAGTTGCCCTGTATGGAACGAACATGGATATT
GTAGGGTCAGGTGGATCTGGAGGTAGCTCTTCTatggtcttcacactcgaagatttcgttggggactggcgacagaca
gccggctacaacctggaccaagtccttgaacagggaggtgtgtccagtttgtttcagaatctcggggtgtccgtaact
ccgatccaaaggattgtcctgagcggtgaaaatgggctgaagatcgacatccatgtcatcatcccgtatgaaggtctg
agcggcgaccaaatgggccagatcgaaaaaattttttaaggtggtgtaccctgtggatgatcatcactttaaggtgatc
ctgcactatggcacactggtaatcgacggggtacgccgaacatgatcgactatttcggacggccgtatgaaggcatc
gccgtgttcgacggcaaaaagatcactgtaacagggacccgtgtggaacggcaacaaaattatcgacgagcgcctgatc
aaccccgacGGC SEQ ID NO: 568 (CP 147(+1) L27V (RIIbB) (aa seq)
MGSLLFRVTINGVTGWRLCERILASSSGGSGGSGMYESFIESLPFLKSLEFSARLKVVDVIGTKVYNDGEQIIAQGDS
ADSFFIIESGEVKITMKRKGKSEVEENGAVEIARCSRGQYFGELALVTNKPRAASAHAIGTVKCLAMDVQAFERLLGP
CMEIMKRNIATYEEQLVALYGTNMDIVGSGGSGGSSSMVFTLEDFVGDWRQTAGYNLDQVLEQGGVSSLFQNLGVSVT
PIQRIVLSGENGLKIDIHVIIPYEGLSGDQMGQIEKIFKVVYPVDDHHFKVILHYGTLVIDGVTPNMIDYFGRPYEGI
AVFDGKKITVTGTLWNGNKIIDERLINPDG
```

SEQUENCE LISTING

SEQ ID NO: 569 (CP 156(+1) L27V (RIIbB) (nt sequence)
ATGaacggagtgaccggctggcggctgtGCGAACGCATTCTGGCtAGCTCAAGCGGAGGTTCAGGCGGTTCCGGAATG
TATGAAAGCTTTATTGAGTCACTGCCATTCCTTAAATCTTTGGAGTTTTCTGCACGCCTGAAAGTAGTAGATGTGATA
GGCACCAAAGTATACAACGATGGAGAACAAATCATTGCTCAGGGAGATTCGGCTGATTCTTTTTTCATTATTGAATCT
GGAGAAGTGAAAATTACTATGAAAAGAAAGGGTAAATCAGAAGTGGAAGAGAATGGTGCAGTAGAAATCGCTCGATGC
TCGCGGGGACAGTACTTTGGAGAGCTTGCCCTGGTAACTAACAAACCTCGAGCAGCTTCTGCCCACGCCATTGGGACT
GTCAAATGTTTAGCAATGGATGTGCAAGCATTTGAAAGGCTTCTGGGACCTTGCATGGAAATTATGAAAAGGAACATC
GCTACCTATGAAGAACAGTTAGTTGCCCTGTATGGAACGAACATGGATATTGTAGGGTCAGGTGGATCTGGAGGTAGC
TCTTCTatggtcttcacactcgaagatttcgttggggactggcgacagacagccggctacaacctggaccaagtcctt
gaacagggaggtgtgtccagtttgtttcagaatctcggggtgtccgtaactccgatccaaaggattgtcctgagcggt
gaaaatgggctgaagatcgacatccatgtcatcatcccgtatgaaggtctgagcggcgaccaaatgggccagatcgaa
aaaatttttaaggtggtgtaccctgtggatgatcatcactttaaggtgatcctgcactatggcacactggtaatcgac
ggggttacgccgaacatgatcgactatttcggacggccgtatgaaggcatcgccgtgttcgacggcaaaaagatcact
gtaacagggaccctgtggaacggcaacaaaattatcgacgagcgcctgatcaaccccgacggctccctgctgttccga
gtaaccatcAAC SEQ ID NO: 570 (CP 156(+1) L27V (RIIbB) (aa seq)
MNGVTGWRLCERILASSSGGSGGSGMYESFIESLPFLKSLEFSARLKVVDVIGTKVYNDGEQIIAQGDSADSFFIIES
GEVKITMKRKGKSEVEENGAVEIARCSRGQYFGELALVTNKPRAASAHAIGTVKCLAMDVQAFERLLGPCMEIMKRNI
ATYEEQLVALYGTNMDIVGSGGSGGSSSMVFTLEDFVGDWRQTAGYNLDQVLEQGGVSSLFQNLGVSVTPIQRIVLSG
ENGLKIDIHVIIPYEGLSGDQMGQIEKIFKVVYPVDDHHFKVILHYGTLVIDGVTPNMIDYFGRPYEGIAVFDGKKIT
VTGTLWNGNKIIDERLINPDGSLLFRVTIN SEQ ID NO: 571 (CP 158(+1) L27V (RIIbB) (nt sequence)
ATGgtgaccggctggcggctgtGCGAACGCATTCTGGCtAGCTCAAGCGGAGGTTCAGGCGGTTCCGGAATGTATGAA
AGCTTTATTGAGTCACTGCCATTCCTTAAATCTTTGGAGTTTTCTGCACGCCTGAAAGTAGTAGATGTGATAGGCACC
AAAGTATACAACGATGGAGAACAAATCATTGCTCAGGGAGATTCGGCTGATTCTTTTTTCATTATTGAATCTGGAGAA
GTGAAAATTACTATGAAAAGAAAGGGTAAATCAGAAGTGGAAGAGAATGGTGCAGTAGAAATCGCTCGATGCTCGCGG
GGACAGTACTTTGGAGAGCTTGCCCTGGTAACTAACAAACCTCGAGCAGCTTCTGCCCACGCCATTGGGACTGTCAAA
TGTTTAGCAATGGATGTGCAAGCATTTGAAAGGCTTCTGGGACCTTGCATGGAAATTATGAAAAGGAACATCGCTACC
TATGAAGAACAGTTAGTTGCCCTGTATGGAACGAACATGGATATTGTAGGGTCAGGTGGATCTGGAGGTAGCTCTTCT
atggtcttcacactcgaagatttcgttggggactggcgacagacagccggctacaacctggaccaagtccttgaacag
ggaggtgtgtccagtttgtttcagaatctcggggtgtccgtaactccgatccaaaggattgtcctgagcggtgaaaat
gggctgaagatcgacatccatgtcatcatcccgtatgaaggtctgagcggcgaccaaatgggccagatcgaaaaaatt
tttaaggtggtgtaccctgtggatgatcatcactttaaggtgatcctgcactatggcacactggtaatcgacggggtt
acgccgaacatgatcgactatttcggacggccgtatgaaggcatcgccgtgttcgacggcaaaaagatcactgtaaca
gggaccctgtggaacggcaacaaaattatcgacgagcgcctgatcaaccccgacggctccctgctgttccgagtaacc
atcaacggaGTG SEQ ID NO: 572 (CP 158(+1) L27V (RIIbB) (aa seq)
MVTGWRLCERILASSSGGSGGSGMYESFIESLPFLKSLEFSARLKVVDVIGTKVYNDGEQIIAQGDSADSFFIIESGE
VKITMKRKGKSEVEENGAVEIARCSRGQYFGELALVTNKPRAASAHAIGTVKCLAMDVQAFERLLGPCMEIMKRNIAT
YEEQLVALYGTNMDIVGSGGSGGSSSMVFTLEDFVGDWRQTAGYNLDQVLEQGGVSSLFQNLGVSVTPIQRIVLSGEN
GLKIDIHVIIPYEGLSGDQMGQIEKIFKVVYPVDDHHFKVILHYGTLVIDGVTPNMIDYFGRPYEGIAVFDGKKITVT
GTLWNGNKIIDERLINPDGSLLFRVTINGV SEQ ID NO: 573 (CP 166(+1) L27V (RIIbB) (nt sequence)
ATGCGCATTCTGGCtAGCTCAAGCGGAGGTTCAGGCGGTTCCGGAATGTATGAAAGCTTTATTGAGTCACTGCCATTC
CTTAAATCTTTGGAGTTTTCTGCACGCCTGAAAGTAGTAGATGTGATAGGCACCAAAGTATACAACGATGGAGAACAA
ATCATTGCTCAGGGAGATTCGGCTGATTCTTTTTTCATTATTGAATCTGGAGAAGTGAAAATTACTATGAAAAGAAAG
GGTAAATCAGAAGTGGAAGAGAATGGTGCAGTAGAAATCGCTCGATGCTCGCGGGGACAGTACTTTGGAGAGCTTGCC
CTGGTAACTAACAAACCTCGAGCAGCTTCTGCCCACGCCATTGGGACTGTCAAATGTTTAGCAATGGATGTGCAAGCA
TTTGAAAGGCTTCTGGGACCTTGCATGGAAATTATGAAAAGGAACATCGCTACCTATGAAGAACAGTTAGTTGCCCTG
TATGGAACGAACATGGATATTGTAGGGTCAGGTGGATCTGGAGGTAGCTCTTCTatggtcttcacactcgaagatttc
gttggggactggcgacagacagccggctacaacctggaccaagtccttgaacagggaggtgtgtccagtttgtttcag
aatctcggggtgtccgtaactccgatccaaaggattgtcctgagcggtgaaaatgggctgaagatcgacatccatgtc
atcatcccgtatgaaggtctgagcggcgaccaaatgggccagatcgaaaaaatttttaaggtggtgtaccctgtggat
gatcatcactttaaggtgatcctgcactatggcacactggtaatcgacggggttacgccgaacatgatcgactatttc
ggacggccgtatgaaggcatcgccgtgttcgacggcaaaaagatcactgtaacagggaccctgtggaacggcaacaaa
attatcgacgagcgcctgatcaaccccgacggctccctgctgttccgagtaaccatcaacggagtgaccggctggcgg
ctgtGCGAACGC SEQ ID NO: 574 (CP 166(+1) L27V (RIIbB) (aa seq)
MRILASSSGGSGGSGMYESFIESLPFLKSLEFSARLKVVDVIGTKVYNDGEQIIAQGDSADSFFIIESGEVKITMKRK
GKSEVEENGAVEIARCSRGQYFGELALVTNKPRAASAHAIGTVKCLAMDVQAFERLLGPCMEIMKRNIATYEEQLVAL
YGTNMDIVGSGGSGGSSSMVFTLEDFVGDWRQTAGYNLDQVLEQGGVSSLFQNLGVSVTPIQRIVLSGENGLKIDIHV
IIPYEGLSGDQMGQIEKIFKVVYPVDDHHFKVILHYGTLVIDGVTPNMIDYFGRPYEGIAVFDGKKITVTGTLWNGNK
IIDERLINPDGSLLFRVTINGVTGWRLCER SEQ ID NO: 575 (linker)
GGGTCAGGTGGATCTGGAGGTAGCTCTTCT SEQ ID NO: 576 (linker)
AGCTCAAGCGGAGGTTCAGGCGGTTCCGGA

SEQUENCE LISTING

```
SEQ ID NO: 577 (LC3 (nt sequence))
ATGCCGTCCGAGAAGACCTTCAAACAGCGCCGGAGCTTCGAACAAAGAGTGGAAGATGTCCGGCTCATCCGGGAGCAG
CACCCCACCAAGATCCCAGTGATTATAGAGCGATACAAGGGTGAGAAGCAGCTGCCCGTCCTGGACAAGACCAGTTCC
TTGTACCTGATCACGTGAATATGAGCGAACTCATCAAGATAATTAGAAGGCGCCTGCAGCTCAATGCTAACCAAGCCT
TCTTCCTCCTGGTGAATGGGCACAGCATGGTGAGTGTGTCCACACCCATCTCTGAAGTGTACGAGAGCGAGAGAGATG
AAGACGGCTTCCTGTACATGGTCTATGCCTCCCAGGAGACGTTCGGGACAGCACTGGCTGTGTAA SEQ ID NO: 578 (LC3 (aa sequence))
MPSEKTFKQRRSFEQRVEDVRLIREQHPTKIPVIIERYKGEKQLPVLDKTKFLVPDHVNMSELIKIIRRRLQLNANQA
FFLLVNGHSMVSVSTPISEVYESERDEDGFLYMVYASQETFGTALAV SEQ ID NO: 579 (pattern sequence)
GSAIVK SEQ ID NO: 580 (pattern sequence)
NHGK SEQ ID NO: 581 (pattern sequence)
SILM SEQ ID NO: 582 (pattern sequence)
AVTK SEQ ID NO: 583 (pattern sequence)
LIVMFY SEQ ID NO: 584 (pattern sequence)
LIVMFY SEQ ID NO: 585 (pattern sequence)
LIVM SEQ ID NO: 586 (pattern sequence)
LIVMWF SEQ ID NO: 587 (pattern sequence)
EKTQ SEQ ID NO: 588 (pattern sequence)
LIVMAKR SEQ ID NO: 589 (pattern sequence)
LIVMAKRG SEQ ID NO: 590 (pattern sequence)
LIVMF SEQ ID NO: 591 (pattern sequence)
LIVMFSYQ SEQ ID NO: 592 OgLuc L27V-LC3 fusions proteins (Nt seq)
ATGGTGTTTACACTCGAAGATTTCGTAGGGGACTGGCGGCAGACAGCCGGCTACAACCTGGACCAAGTCCTTGAGCAG
GGCGGTGTGTCCAGTTTGTTTCAGAATCTCGGGGTGTCCGTAACTCCGATCCAAAGGATTGTCCTGAGCGGTGAAAAC
GGCCTGAAGATCGACATCCATGTCATCATCCCGTATGAAGGTCTGAGCGGCGATCAGATGGGCCAGATCGAAAAAATT
TTTAAGGTGGTGTACCCTGTGGATGATCATCACTTTAAGGTGATTCTGCACTATGGCACACTGGTAATCGACGGGGTT
ACGCCGAACATGATCGACTATTTCGGACGGCCGTATGAAGGCATCGCCGTGTTCGACGGCAAAAAGATCACTGTAACC
GGGACCCTGTGGAACGGCAACAAAATTATCGACGAGCGCCTGATCAACCCCGACGGCTCCCTGCTGTTCCGCGTAACC
ATCAACGGAGTGACCGGCTGGCGGCTGTGCGAGAGAATTTTGGCGGGCTCGAGCGGAGGTGGAGGTTCAGGTGGTGGC
GGGAGCGGTGGAATGCCGTCCGAGAAGACCTTCAAACAGCGCCGGAGCTTCGAACAAAGAGTGGAAGATGTCCGGCTC
ATCCGGGAGCAGCACCCCACCAAGATCCCAGTGATTATAGAGCGATACAAGGGTGAGAAGCAGCTGCCCGTCCTGGAC
AAGACCAAGTTCCTTGTACCTGATCACGTGAATATGAGCGAACTCATCAAGATAATTAGAAGGCGCCTGCAGCTCAAT
GCTAACCAAGCCTTCTTCCTCCTGGTGAATGGGCACAGCATGGTGAGTGTGTCCACACCCATCTCTGAAGTGTACGAG
AGCGAGAGAGATGAAGACGGCTTCCTGTACATGGTCTATGCCTCCCAGGAGACGTTCGGGACAGCACTGGCTGTGTAA SEQ ID NO: 593 OgLuc L27V-LC3 fusions proteins (aa seq)
MVFTLEDFVGDWRQTAGYNLDQVLEQGGVSSLFQNLGVSVTPIQRIVLSGENGLKIDIHVIIPYEGLSGDQMGQIEKI
FKVVYPVDDHHFKVILHYGTLVIDGVTPNMIDYFGRPYEGIAVFDGKKITVTGTLWNGNKIIDERLINPDGSLLFRVT
INGVTGWRLCERILAGSSGGGGSGGGGSGGMPSEKTFKQRRSFEQRVEDVRLIREQHPTKIPVIIERYKGEKQLPVLD
KTKFLVPDHVNMSELIKIIRRRLQLNANQAFFLLVNGHSMVSVSTPISEVYESERDEDGFLYMVYASQETFGTALAV
```

SEQUENCE LISTING (593 sequences)

SEQ ID NO: 1 - protein, 169 aa, Oplophorus gracilirostris
FTLADFVGDWQQTAGYNQDQVLEQGGLSSLFQALGVSVTPIQKVVLSGENGLKADIHVIIPYEGLSGFQMGLIEMIFKVVYPVDDHHFKIILHYGTLVIDGVTPNMIDYFGRPYPGIAVFDGKQITVTGTLWNGNKIYDERLINPDGSLLFRVTINGVTGWRLCENILA

SEQ ID NO: 2 - DNA, 513 bp, Artificial Sequence
  Description of Artificial Sequence: Synthetic polynucleotide
atggtgtttacattggaggatttcgttggagactggcggcagacagctggatacaaccaagatcaagtgttagaacaaggaggattgtctagtctgttccaaaagctgggagtgtcagtcaccccaatccagaaaattgtgctgtctggggagaatgggttaaaatttgatattcatgtcatcatcccttacgagggactcagtggttttcaaatgggtctgattgaaatgatcttcaaagttgtttacccagtggatgatcatcatttcaagattattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgcc

SEQ ID NO: 3 - protein, 171 aa, Artificial Sequence
  Description of Artificial Sequence: Synthetic polypeptide
MVFTLEDFVGDWRQTAGYNQDQVLEQGGLSSLFQKLGVSVTPIQKIVLSGENGLKFDIHVIIPYEGLSGFQMGLIEMIFKVVYPVDDHHFKIILHYGTLVIDGVTPNMIDYFGRPYEGIAVFDGKKITVTGTLWNGNKIIDERLINPDGSLLFRVTINGVTGWRLCERILA

SEQ ID NO: 4 - DNA, 513 bp, Artificial Sequence
  Description of Artificial Sequence: Synthetic polynucleotide
atggtgtttacattggaggatttcgttggagactggcggcagacagctggatacaacctagatcaagtgttagaacaaggaggattgtctagtctgttccaaaagctgggagtgtcagtcaccccaatccagaaaattgtgctgtctggggagaatgggttaaaaattgatattcatgtcatcatcccttacgagggactcagtggttttcaaatgggtctgattgaaatgatcttcaaagttgtttacccagtggatgatcatcatttcaagattattcaccattatggtacactcgttattgacggtgtgacaccaaacatgattgacttctttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgcc

SEQ ID NO: 5 - protein, 171 aa, Artificial Sequence
  Description of Artificial Sequence: Synthetic polypeptide
MVFTLEDFVGDWRQTAGYNLDQVLEQGGLSSLFQKLGVSVTPIQKIVLSGENGLKIDIHVIIPYEGLSGFQMGLIEMIFKVVYPVDDHHFKIIHHYGTLVIDGVTPNMIDFFGRPYEGIAVFDGKKITVTGTLWNGNKIIDERLINPDGSLLFRVTINGVTGWRLCERILA

SEQ ID NO: 6 - DNA, 513 bp, Artificial Sequence
  Description of Artificial Sequence: Synthetic polynucleotide
atggtgtttacattggaggatttcgttggagactggcggcagacagctggatacaacctagatcaactgttagaacaaggaggattgtctagtctgttccaaaagctgggagtgtcagtcaccccaatccagaaaattgtgctgtctggggagaatgggttaaaaattgatattcatgtcatcatcccttacgagggactcagtggttatcaaatgggtcagattgaaaagatcttcaaagttgtttacccagtggatgatcatcatttcaagattattcgccattatggtacactcgttattgacggtgtgacaccaaacatgattgacttctttggacgcccttacgagggaattgctgtgtttgacggcaagaagatcacagttactggaactctgtggaacggcaacaagatcattgatgagcgcctgatcaacccagatggttcactcctcttccgcgttactatcaatggaatcaccggatggcgcctttgcgagcgtattcttgcc

SEQ ID NO: 7 - protein, 171 aa, Artificial Sequence
  Description of Artificial Sequence: Synthetic polypeptide
MVFTLEDFVGDWRQTAGYNLDQLLEQGGLSSLFQKLGVSVTPIQKIVLSGENGLKIDIHVIIPYEGLSGYQMGQIEKIFKVVYPVDDHHFKIIRHYGTLVIDGVTPNMIDFFGRPYEGIAVFDGKKITVTGTLWNGNKIIDERLINPDGSLLFRVTINGITGWRLCERILA

SEQ ID NO: 8 - DNA, 513 bp, Artificial Sequence
  Description of Artificial Sequence: Synthetic polynucleotide
atggtgtttacattggaggatttcgttggagactggcggcagacagctggatacaaccaagatcaagtgttagaacaaggaggattgtctagtctgttccaaaagctgggagtgtcagtcaccccaatccagaaaattgtgctgtctggggagaatgggttaaaaattgatattcatgtcatcatcccttacgagggactcagtggttttcaaatgggtctgattgaaatgatctacaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgcc

SEQ ID NO: 9 - protein, 171 aa, Artificial Sequence
  Description of Artificial Sequence: Synthetic polypeptide
MVFTLEDFVGDWRQTAGYNQDQVLEQGGLSSLFQKLGVSVTPIQKIVLSGENGLKIDIHVIIPYEGLSGFQMGLIEMIYKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 10 - DNA, 513 bp, Artificial Sequence
  Description of Artificial Sequence: Synthetic polynucleotide
atggtgtttacattggaggattacgttggagactggcggcagacagctggatacaaccaagatcaagtgttagaacaaggaggattgtctagtctgttccaaaatctgggagtgtctgtcaccccaatccagaaaattgtgctgtctggggagaatgggttaaaaattgatattcatgtcatcatcccttacgagggactcagtggttttcaaatgggtctgattgaaatgatctacaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcgacaagatcattgatgagcgcctgatcaacccagatggttcactcctcttccgcgttactaccaatggagtcaccggatggcgcctttgcgagcgtattcttgcc

SEQ ID NO: 11 - protein, 171 aa, Artificial Sequence
  Description of Artificial Sequence: Synthetic polypeptide
MVFTLEDYVGDWRQTAGYNQDQVLEQGGLSSLFQNLGVSVTPIQKIVLSGENGLKIDIHVIIPYEGLSGFQMGLIEMIYKVVYPVDDHHFKVILHYGTLVIDGVTPNMIDYFGRPYEGIAVFDGKKITVTGTLWNGDKIIDERLINPDGSLLFRVTTNGVTGWRLCERILA

SEQ ID NO: 12 - DNA, 513 bp, Artificial Sequence
  Description of Artificial Sequence: Synthetic polynucleotide
atggtgtttacattggaggatttcgttggagactggcggcagacagctggatacaaccaagatcaagtgttagaacaaggaggagtgtctagtctgttccaaaagctgggagtgtcaatcaccccaatccagaaaattgtgctgtctggggagaatgggttaaaaattgatattcatgtcatcatcccttacgagggactcagtggttttcaaatgggtctgattgaaatgatctacaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcaatcctcttccgcgttactatcaatggagtcaccggatggcgcctttgcgagcgtattcttgcc

SEQ ID NO: 13 - protein, 171 aa, Artificial Sequence
  Description of Artificial Sequence: Synthetic polypeptide
MVFTLEDFVGDWRQTAGYNQDQVLEQGGVSSLFQKLGVSITPIQKIVLSGENGLKIDIHVIIPYEGLSGFQMGLIEMIYKVVYPVDDHHFKVILHYGTLVIDGVTPNMIDYFGRPYEGIAVFDGKKITVTGTLWNGNKIIDERLINPDGSILFRVTINGVTGWRLCERILA

SEQ ID NO: 14 - DNA, 513 bp, Artificial Sequence
  Description of Artificial Sequence: Synthetic polynucleotide
atggtgtttacattggaggatttcgttggagactggcggcagacagctggatacaaccaagatcaagtgttagaacaaggaggattgtctagtctgttccaaaagctgggagtgtcagtcaccccaatccagaaaattgtgctgtctggggagaatgggttaaaaattgatattcatgtcatcatcccttacgagggactcagtggttttcaaatgggtctgattgaaatgatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgcc

SEQ ID NO: 15 - protein, 171 aa, Artificial Sequence
  Description of Artificial Sequence: Synthetic polypeptide
MVFTLEDFVGDWRQTAGYNQDQVLEQGGLSSLFQKLGVSVTPIQKIVLSGENGLKIDIHVIIPYEGLSGFQMGLIEMIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 16 - DNA, 513 bp, Artificial Sequence
  Description of Artificial Sequence: Synthetic polynucleotide
atggtgtttacattgaaggatttcgttggagactggcggcagacagctggatacaaccaagatcaagtgttagaacaaggaggattgtctagtctgttccaaaatctgggagtgtcagtcaccccaatccagaaaattgtgctgtctggggagaatgggttaaaaattgatattcatgtcatcatcccttacgagggactcagtggttatcaaatgggtcagattgaaaagatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgcc

SEQ ID NO: 17 - protein, 171 aa, Artificial Sequence
  Description of Artificial Sequence: Synthetic polypeptide
MVFTLKDFVGDWRQTAGYNQDQVLEQGGLSSLFQNLGVSVTPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 18 - DNA, 513 bp, Artificial Sequence
  Description of Artificial Sequence: Synthetic polynucleotide
atggtgtttacattggaggatttcgttggagactggcggcagacagctggatacaacctagatcaagtgttagaacaaggaggattgtctagtctgttccaaaagctgggagtgtcagtcaccccaatccagaaaattgtgctgtctggggagaatgggttaaaaattgatattcatgtcatcatcccttacgagggactcagtggttatcaaatgggtcagattgaaaagatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgcc

SEQ ID NO: 19 - protein, 171 aa, Artificial Sequence
  Description of Artificial Sequence: Synthetic polypeptide
MVFTLEDFVGDWRQTAGYNLDQVLEQGGLSSLFQKLGVSVTPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 20 - DNA, 513 bp, Artificial Sequence
  Description of Artificial Sequence: Synthetic polynucleotide
atggtgtttacattggaggatttcgttggagactggcggcagacagctggatacaacctagatcaagtgttagaacaaggaggagtgtctagtctgttccaaaagctgggagtgtcaatcaccccaatccagaaaattgtgctgtctggggagaatgggttaaaaattgatattcatgtcatcatcccttacgagggactcagtggttatcaaatgggtcagattgaaaagatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgcc

SEQ ID NO: 21 - protein, 171 aa, Artificial Sequence
  Description of Artificial Sequence: Synthetic polypeptide
MVFTLEDFVGDWRQTAGYNLDQVLEQGGVSSLFQKLGVSITPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 22 - DNA, 513 bp, Artificial Sequence
  Description of Artificial Sequence: Synthetic polynucleotide
atggtgtttacactcgaagatttcgtaggggactggcggcagacagccggctacaaccaagaccaagtccttgagcagggcggtctgtccagtttgtttcagaaactcggggtgtccgtaacaccgatccaaaagattgtcctgagcggtgaaaacggcctgaagatcgacatccatgtcatcatcccgtatgaaggtctgagcggcttccagatgggcctcattgagatgatctttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcg

SEQ ID NO: 23 - DNA, 513 bp, Artificial Sequence
  Description of Artificial Sequence: Synthetic polynucleotide
atggtattcacactggaggattttgtcggtgattggcggcaaaccgctgggtacaaccaggaccaggttctcgaacaagggggcctcagctccctgtttcaaaaactgggtgttagcgttacacctattcaaaaaatcgtgctctccggggaaaacgggctcaaaatcgatattcatgtgattatcccttacgaagggctctccgggtttcagatggggctgatcgaaatgatctttaaggtcgtctatcccgtagatgatcaccacttcaaggtgatcctccactacgggaccctcgtaattgatggcgtgacccccaacatgatcgactattttgggcgcccttacgaggggattgctgtcttcgatggcaaaaaaattacagtgacaggcacactctggaacgggaataagatcattgatgagcgcctgattaatcccgatgggagcctgctctttcgggtgacaattaacggcgtaacaggctggcgcctctgtgaacggattctggcg

SEQ ID NO: 24 - DNA, 513 bp, Artificial Sequence
  Description of Artificial Sequence: Synthetic polynucleotide
atggtgtttacactcgaagatttcgtaggggactggcggcagacagccggctacaacctggaccaagtccttgagcagggcggtctgtccagtttgtttcagaaactcggggtgtccgtaacaccgatccaaaagattgtcctgagcggtgaaaacggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcg

SEQ ID NO: 25 - DNA, 513 bp, Artificial Sequence
  Description of Artificial Sequence: Synthetic polynucleotide
atggtattcacactggaggattttgtcggtgattggcggcaaaccgctgggtacaacctcgaccaggttctcgaacaagggggcctcagctccctgtttcaaaaactgggtgttagcgttacacctattcaaaaaatcgtgctctccggggaaaacgggctcaaaatcgatattcatgtgattatcccttacgaagggctctccgggtatcagatggggcagatcgaaaaaatctttaaggtcgtctatcccgtagatgatcaccacttcaaggtgatcctccactacgggaccctcgtaattgatggcgtgacccccaacatgatcgactattttgggcgcccttacgaggggattgctgtcttcgatggcaaaaaaattacagtgacaggcacactctggaacgggaataagatcattgatgagcgcctgattaatcccgatgggagcctgctctttcgggtgacaattaacggcgtaacaggctggcgcctctgtgaacggattctggcg

SEQ ID NO: 26 - DNA, 513 bp, Artificial Sequence
  Description of Artificial Sequence: Synthetic polynucleotide
atggtgattacattggaggatttcgttggagactggcggcagacagctggatacaaccaagatcaagtgttagaacaaggaggagtgtctagtctgttccaaaagctgggagtgtcaatcaccccaatccagaaaattgtgctgtctggggagaatgggttaaaaattgatattcatgtcatcatcccttacgagggactcagtggttttcaaatgggtctgattgaaatgatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgcc

SEQ ID NO: 27 - protein, 171 aa, Artificial Sequence
  Description of Artificial Sequence: Synthetic polypeptide
MVITLEDFVGDWRQTAGYNQDQVLEQGGVSSLFQKLGVSITPIQKIVLSGENGLKIDIHVIIPYEGLSGFQMGLIEMIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 28 - DNA, 1650 bp, Photinus pyralis
atggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtt

SEQ ID NO: 29 - protein, 550 aa, Photinus pyralis
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAV

SEQ ID NO: 30 - DNA, 933 bp, Artificial Sequence
  Description of Artificial Sequence: Synthetic polynucleotide
atggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcag

SEQ ID NO: 31 - protein, 311 aa, Artificial Sequence
  Description of Artificial Sequence: Synthetic polypeptide
MASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQ

SEQ ID NO: 32 - DNA, 2295 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcaggtttctctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 33 - protein, 765 aa, Artificial Sequence
  Description of Artificial Sequence: Synthetic polypeptide
MLGLSEQSVSISRCAGTRLPALLDEQQVNVLLYDMNGCYSRLKELVPTLPQNRKVSKVEILQHVIDYIRDLQLELNSESEVGTTGGRGLPVRAPLSTLNGEISALAAEAACVPADDRILCRVSLENLYFQASGGGGGAIAMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQVSLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 34 - DNA, 1455 bp, Artificial Sequence
  Description of Artificial Sequence: Synthetic polynucleotide
atggtgattacattggaggatttcgttggagactggcggcagacagctggatacaaccaagatcaagtgttagaacaaggaggagtgtctagtctgttccaaaagctgggagtgtcaatcaccccaatccagaaaattgtgctgtctggggagaatgggttaaaaattgatattcatgtcatcatcccttacgagggactcagtggttttcaaatgggtctgattgaaatgatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgccggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 35 - protein, 485 aa, Artificial Sequence
  Description of Artificial Sequence: Synthetic polypeptide
MVITLEDFVGDWRQTAGYNQDQVLEQGGVSSLFQKLGVSITPIQKIVLSGENGLKIDIHVIIPYEGLSGFQMGLIEMIFKVVYPVDDHHFKVILHYGTLVIDGVTPNMIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 36 - DNA, 1455 bp, Artificial Sequence
  Description of Artificial Sequence: Synthetic polynucleotide
atggtgtttacattggaggatttcgttggagactggcggcagacagctggatacaacctagatcaagtgttagaacaaggaggattgtctagtctgttccaaaagctgggagtgtcagtcaccccaatccagaaaattgtgctgtctggggagaatgggttaaaaattgatattcatgtcatcatcccttacgagggactcagtggttatcaaatgggtcagattgaaaagatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgccggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 37 - protein, 485 aa, Artificial Sequence
  Description of Artificial Sequence: Synthetic polypeptide
MVFTLEDFVGDWRQTAGYNLDQVLEQGGLSSLFQKLGVSVTPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 38 - DNA, 1455 bp, Artificial Sequence
  Description of Artificial Sequence: Synthetic polynucleotide
atggtgtttacattggaggatttcgttggagactggcggcagacagctggatacaacctagatcaagtgttagaacaaggaggagtgtctagtctgttccaaaagctgggagtgtcaatcaccccaatccagaaaattgtgctgtctggggagaatgggttaaaaattgatattcatgtcatcatcccttacgagggactcagtggttatcaaatgggtcagattgaaaagatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgccggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 39 - protein, 485 aa, Artificial Sequence
  Description of Artificial Sequence: Synthetic polypeptide
MVFTLEDFVGDWRQTAGYNLDQVLEQGGVSSLFQKLGVSITPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 40 - DNA, 1876 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggtgtttacactcgaagatttcgtaggggactggcggcagacagccggctacaacctggaccaagtccttgagcagggcggtctgtccagtttgtttcagaaactcggggtgtccgtaacaccgatccaaaagattgtcctgagcggtgaaaacggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgtattcttgccggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggtt

SEQ ID NO: 41 - protein, 625 aa, Artificial Sequence
  Description of Artificial Sequence: Synthetic polypeptide
MLGLSEQSVSISRCAGTRLPALLDEQQVNVLLYDMNGCYSRLKELVPTLPQNRKVSKVEILQHVIDYIRDLQLELNSESEVGTTGGRGLPVRAPLSTLNGEISALAAEAACVPADDRILCRVSLENLYFQASGGGGGAIAMVFTLEDFVGDWRQTAGYNLDQVLEQGGLSSLFQKLGVSVTPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 42 - DNA, 513 bp, Artificial Sequence
  Description of Artificial Sequence: Synthetic polynucleotide
atggtgtttacactcgaagatttcgtaggggactggcggcagacagccggctacaacctggaccaagtccttgagcagggcggtctgtccagtttgtttcagaatctcggggtgtccgtaacaccgatccaaaagattgtcctgagcggtgaaaacggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcg

SEQ ID NO: 43 - protein, 171 aa, Artificial Sequence
  Description of Artificial Sequence: Synthetic polypeptide
MVFTLEDFVGDWRQTAGYNLDQVLEQGGLSSLFQNLGVSVTPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 44 - DNA, 1455 bp, Artificial Sequence
  Description of Artificial Sequence: Synthetic polynucleotide
atggtgtttacattggaggatttcgttggagactggcggcagacagctggatacaacctagatcaagtgttagaacaaggaggattgtctagtctgttccaaaagctgggagtgtcagtcaccccaatccagaaaattgtgctgtctggggagaatgggttaaaaattgatattcatgtcatcatcccttacgagggactcagtggttttcaaatgggtctgattgaaatgatcttcaaagttgtttacccagtggatgatcatcatttcaagattattcaccattatggtacactcgttattgacggtgtgacaccaaacatgattgacttctttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgccggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 45 - protein, 485 aa, Artificial Sequence
  Description of Artificial Sequence: Synthetic polypeptide
MVFTLEDFVGDWRQTAGYNLDQVLEQGGLSSLFQKLGVSVTPIQKIVLSGENGLKIDIHVIIPYEGLSGFQMGLIEMIFKVVYPVDDHHFKIIHHYGTLVIDGVTPNMIDFFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 46 - DNA, 513 bp, Artificial Sequence
  Description of Artificial Sequence: Synthetic polynucleotide
atggtgtttacattggaggatttcgttggagactggcggcagacagctggatacaaccaagatcaagtgttagaacaaggaggagtgtctagtctgttccaaaagctgggagtgtcagtcaccccaatccagaaaattgtgctgtctggggagaatgggttaaaaattgatattcatgtcatcatcccttacgagggactcagtggttttcaaatgggtctgattgaaatgatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgcc

SEQ ID NO: 47 - protein, 171 aa, Artificial Sequence
  Description of Artificial Sequence: Synthetic polypeptide
MVFTLEDFVGDWRQTAGYNQDQVLEQGGVSSLFQKLGVSVTPIQKIVLSGENGLKIDIHVIIPYEGLSGFQMGLIEMIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 48 - DNA, 1455 bp, Artificial Sequence
  Description of Artificial Sequence: Synthetic polynucleotide
atggtgtttacattggaggatttcgttggagactggcggcagacagctggatacaaccaagatcaagtgttagaacaaggaggattgtctagtctgttccaaaagctgggagtgtcagtcaccccaatccagaaaattgtgctgtctggggagaatgggttaaaaattgatattcatgtcatcatcccttacgagggactcagtggttttcaaatgggtctgattgaaatgatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgccggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 49 - protein, 485 aa, Artificial Sequence
  Description of Artificial Sequence: Synthetic polypeptide
MVFTLEDFVGDWRQTAGYNQDQVLEQGGLSSLFQKLGVSVTPIQKIVLSGENGLKIDIHVIIPYEGLSGFQMGLIEMIFKVVYPVDDHHFKVILHYGTLVIDGVTPNMIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 50 - DNA, 1455 bp, Artificial Sequence
  Description of Artificial Sequence: Synthetic polynucleotide
atggtgtttacattggaggatttcgttggagactggcggcagacagctggatacaaccaagatcaagtgttagaacaaggaggagtgtctagtctgttccaaaagctgggagtgtcagtcaccccaatccagaaaattgtgctgtctggggagaatgggttaaaaattgatattcatgtcatcatcccttacgagggactcagtggttttcaaatgggtctgattgaaatgatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgccggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 51 - protein, 485 aa, Artificial Sequence
  Description of Artificial Sequence: Synthetic polypeptide
MVFTLEDFVGDWRQTAGYNQDQVLEQGGVSSLFQKLGVSVTPIQKIVLSGENGLKIDIHVIIPYEGLSGFQMGLIEMIFKVVYPVDDHHFKVILHYGTLVIDGVTPNMIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 52 - DNA, 1455 bp, Artificial Sequence
  Description of Artificial Sequence: Synthetic polynucleotide
atggtgtttacattgaaggatttcgttggagactggcggcagacagctggatacaaccaagatcaagtgttagaacaaggaggattgtctagtctgttccaaaatctgggagtgtcagtcaccccaatccagaaaattgtgctgtctggggagaatgggttaaaaattgatattcatgtcatcatcccttacgagggactcagtggttatcaaatgggtcagattgaaaagatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgccggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 53 - protein, 485 aa, Artificial Sequence
  Description of Artificial Sequence: Synthetic polypeptide
MVFTLKDFVGDWRQTAGYNQDQVLEQGGLSSLFQNLGVSVTPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 54 - DNA, 81 bp, Oplophorus gracilirostris
atggcttactccacactgttcatcattgctctcacagccgtcgtaacacaagcctcctccacacagaaaagcaacctgaca

SEQ ID NO: 55 - DNA, 1875 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggtgtttacattggaggatttcgttggagactggcggcagacagctggatacaaccaagatcaagtgttagaacaaggaggattgtctagtctgttccaaaagctgggagtgtcagtcaccccaatccagaaaattgtgctgtctggggagaatgggttaaaatttgatattcatgtcatcatcccttacgagggactcagtggttttcaaatgggtctgattgaaatgatcttcaaagttgtttacccagtggatgatcatcatttcaagattattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgccggatctctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 56 - protein, 625 aa, Artificial Sequence
  Description of Artificial Sequence: Synthetic polypeptide
MLGLSEQSVSISRCAGTRLPALLDEQQVNVLLYDMNGCYSRLKELVPTLPQNRKVSKVEILQHVIDYIRDLQLELNSESEVGTTGGRGLPVRAPLSTLNGEISALAAEAACVPADDRILCRVSLENLYFQASGGGGGAIAMVFTLEDFVGDWRQTAGYNQDQVLEQGGLSSLFQKLGVSVTPIQKIVLSGENGLKFDIHVIIPYEGLSGFQMGLIEMIFKVVYPVDDHHFKIILHYGTLVIDGVTPNMIDYFGRPYEGIAVFDGKKITVTGTLWNGNKIIDERLINPDGSLLFRVTINGVTGWRLCERILAGSLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 57 - DNA, 1875 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggtgtttacattggaggatttcgttggagactggcggcagacagctggatacaaccaagatcaagtgttagaacaaggaggattgtctagtctgttccaaaagctgggagtgtcagtcaccccaatccagaaaattgtgctgtctggggagaatgggttaaaaattgatattcatgtcatcatcccttacgagggactcagtggttttcaaatgggtctgattgaaatgatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgccgtttctctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 58 - protein, 625 aa, Artificial Sequence
  Description of Artificial Sequence: Synthetic polypeptide
MLGLSEQSVSISRCAGTRLPALLDEQQVNVLLYDMNGCYSRLKELVPTLPQNRKVSKVEILQHVIDYIRDLQLELNSESEVGTTGGRGLPVRAPLSTLNGEISALAAEAACVPADDRILCRVSLENLYFQASGGGGGAIAMVFTLEDFVGDWRQTAGYNQDQVLEQGGLSSLFQKLGVSVTPIQKIVLSGENGLKIDIHVIIPYEGLSGFQMGLIEMIFKVVYPVDDHHFKVILHYGTLVIDGVTPNMIDYFGRPYEGIAVFDGKKITVTGTLWNGNKIIDERLINPDGSLLFRVTINGVTGWRLCERILAVSLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 59 - DNA, 1875 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggtgtttacactcgaagatttcgtaggggactggcggcagacagccggctacaacctggaccaagtccttgagcagggcggtctgtccagtttgtttcagaatctcggggtgtccgtaacaccgatccaaaagattgtcctgagcggtgaaaacggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 60 - protein, 625 aa, Artificial Sequence
  Description of Artificial Sequence: Synthetic polypeptide
MLGLSEQSVSISRCAGTRLPALLDEQQVNVLLYDMNGCYSRLKELVPTLPQNRKVSKVEILQHVIDYIRDLQLELNSESEVGTTGGRGLPVRAPLSTLNGEISALAAEAACVPADDRILCRVSLENLYFQASGGGGGAIAMVFTLEDFVGDWRQTAGYNLDQVLEQGGLSSLFQNLGVSVTPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 61 - DNA, 1875 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggtgtttacattggaggatttcgttggagactggcggcagacagctggatacaacctagatcaagtgttagaacaaggaggattgtctagtctgttccaaaagctgggagtgtcagtcaccccaatccagaaaattgtgctgtctggggagaatgggttaaaaattgatattcatgtcatcatcccttacgagggactcagtggttatcaaatgggtcagattgaaaagatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgccgtttctctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 62 - protein, 625 aa, Artificial Sequence
  Description of Artificial Sequence: Synthetic polypeptide
MLGLSEQSVSISRCAGTRLPALLDEQQVNVLLYDMNGCYSRLKELVPTLPQNRKVSKVEILQHVIDYIRDLQLELNSESEVGTTGGRGLPVRAPLSTLNGEISALAAEAACVPADDRILCRVSLENLYFQASGGGGGAIAMVFTLEDFVGDWRQTAGYNLDQVLEQGGLSSLFQKLGVSVTPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAVSLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 63 - DNA, 1875 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggtgtttacattggaggatttcgttggagactggcggcagacagctggatacaacctagatcaagtgttagaacaaggaggagtgtctagtctgttccaaaagctgggagtgtcaatcaccccaatccagaaaattgtgctgtctggggagaatgggttaaaaattgatattcatgtcatcatcccttacgagggactcagtggttatcaaatgggtcagattgaaaagatcttcaaagttgtttacccagtggatgatcatcatttcaaggttattctccattatggtacactcgttattgacggtgtgacaccaaacatgattgactactttggacgcccttacgagggaattgctgtgtttgacggcaagaagatcacagttactggaactctgtggaacggcaacaagatcattgatgagcgcctgatcaacccagatggttcactcctcttccgcgttactatcaatggagtcaccggatggcgcctttgcgagcgtattcttgccgtttctctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 64 - protein, 625 aa, Artificial Sequence
  Description of Artificial Sequence: Synthetic polypeptide
MLGLSEQSVSISRCAGTRLPALLDEQQVNVLLYDMNGCYSRLKELVPTLPQNRKVSKVEILQHVIDYIRDLQLELNSESEVGTTGGRGLPVRAPLSTLNGEISALAAEAACVPADDRILCRVSLENLYFQASGGGGGAIAMVFTLEDFVGDWRQTAGYNLDQVLEQGGVSSLFQKLGVSITPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAVSLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 65 - DNA, 636 bp, Artificial Sequence
  Description of Artificial Sequence: Synthetic polynucleotide
atggtgtttacactcgaagatttcgtaggggactggcggcagacagccggctacaacctggaccaagtccttgagcagggcggtctgtccagtttgtttcagaaactcggggtgtccgtaacaccgatccaaaagattgtcctgagcggtgaaaacggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgaattctcacggcttccctcccgaggtggaggagcaggccgccggcaccctgcccatgagctgcgcccaggagagcggcatggatagacaccctgctgcttgcgccagcgccaggatcaacgtc

SEQ ID NO: 66 - DNA, 82 bp, Unknown
  Description of Unknown: antioxidant response element (2X ARE) oligonucleotide
tagcttggaaatgacattgctaatggtgacaaagcaacttttagcttggaaatgacattgctaatggtgacaaagcaacttt

SEQ ID NO: 67 - DNA, 45 bp, Unknown
  Description of Unknown: heat shock response element (HRE) oligonucleotide
ctggaattttctagactggaattttctagactggaattttctaga

SEQ ID NO: 68 - DNA, 516 bp, Artificial Sequence
  Description of Artificial Sequence: Synthetic polynucleotide
atggtgtttacactcgaagatttcgtaggggactggcggcagacagccggctacaacctggaccaagtccttgagcagggcggtctgtccagtttgtttcagaatctcggggtgtccgtaacaccgatccaaaagattgtcctgagcggtgaaaacggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcggga

SEQ ID NO: 69 - protein, 172 aa, Artificial Sequence
  Description of Artificial Sequence: Synthetic polypeptide
MVFTLEDFVGDWRQTAGYNLDQVLEQGGLSSLFQNLGVSVTPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAG

SEQ ID NO: 70 - DNA, 516 bp, Artificial Sequence
  Description of Artificial Sequence: Synthetic polynucleotide
atggtgtttacactcgaagatttcgtaggggactggcggcagacagccggctacaacctggaccaagtccttgagcagggcggtctgtccagtttgtttcagaatctcggggtgtccgtaactccgatccaaaagattgtcctgagcggtgaaaacggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcggga

SEQ ID NO: 71 - protein, 172 aa, Artificial Sequence; identical to SEQ ID NO: 69
  Description of Artificial Sequence: Synthetic polypeptide

SEQ ID NO: 72 - DNA, 516 bp, Artificial Sequence
  Description of Artificial Sequence: Synthetic polynucleotide
atggtgtttacactcgaagatttcgtaggggactggcggcagacagccggctacaacctggaccaagtccttgagcagggcggcctgtccagtttgtttcagaatctcggggtgtccgtaacaccgatccaaaagattgtcctgagcggtgaaaacggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacttgatcgactatttcggacgtccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcggga

SEQ ID NO: 73 - protein, 172 aa, Artificial Sequence
  Description of Artificial Sequence: Synthetic polypeptide
MVFTLEDFVGDWRQTAGYNLDQVLEQGGLSSLFQNLGVSVTPIQKIVLSGENGLKIDIHVIIPYEGLSGYQMGQIEKIFKVVYPVDDHHFKVILHYGTLVIDGVTPNLIDYFGRPYEGIAVFDGKKITVTGTLWNGNKIIDERLINPDGSLLFRVTINGVTGWRLCERILAG

SEQ ID NO: 74 - DNA, 516 bp, Artificial Sequence
  Description of Artificial Sequence: Synthetic polynucleotide
atggtgtttacactcgaagatttcgtaggggactggcagcagacagccggctacaacctggaccaagtccttgagcagggcggtctgtccagtttgtttcagaatctcggggtgtccgtaactccgatccaaaagattgtcctgagcggtgaaaacggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcggga

SEQ ID NO: 75 - protein, 172 aa, Artificial Sequence
  Description of Artificial Sequence: Synthetic polypeptide
MVFTLEDFVGDWQQTAGYNLDQVLEQGGLSSLFQNLGVSVTPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAG

SEQ ID NO: 76 - DNA, 1797 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggtgtttacactcgaagatttcgtaggggactggcggcagacagccggctacaacctggaccaagtccttgagcagggcggcctgtccagtttgtttcagaatctcggggtgtccgtaacaccgatccaaaagattgtcctgagcggtgaaaacggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacttgatcgactatttcggacgtccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctg

SEQ ID NO: 77 - protein, 599 aa, Artificial Sequence
  Description of Artificial Sequence: Synthetic polypeptide
MLGLSEQSVSISRCAGTRLPALLDEQQVNVLLYDMNGCYSRLKELVPTLPQNRKVSKVEILQHVIDYIRDLQLELNSESEVGTTGGRGLPVRAPLSTLNGEISALAAEAACVPADDRILCRVSLENLYFQASGGGGGAIAMVFTLEDFVGDWRQTAGYNLDQVLEQGGLSSLFQNLGVSVTPIQKIVLSGENGLKIDIHVIIPYEGLSGYQMGQIEKIFKVVYPVDDHHFKVILHYGTLVIDGVTPNLIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGL

SEQ ID NO: 78 - DNA, 1875 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggtgtttacactcgaagatttcgtaggggactggcagcagacagccggctacaacctggaccaagtccttgagcagggcggtctgtccagtttgtttcagaatctcggggtgtccgtaactccgatccaaaagattgtcctgagcggtgaaaacggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 79 - protein, 625 aa, Artificial Sequence
  Description of Artificial Sequence: Synthetic polypeptide
MLGLSEQSVSISRCAGTRLPALLDEQQVNVLLYDMNGCYSRLKELVPTLPQNRKVSKVEILQHVIDYIRDLQLELNSESEVGTTGGRGLPVRAPLSTLNGEISALAAEAACVPADDRILCRVSLENLYFQASGGGGGAIAMVFTLEDFVGDWQQTAGYNLDQVLEQGGLSSLFQNLGVSVTPIQKIVLSGENGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 80 - DNA, 516 bp, Artificial Sequence
  Description of Artificial Sequence: Synthetic polynucleotide
atggtgtttacactcgaagatttcgtaggggactggcggcagacagccggctacaacctggaccaagtccttgagcagggcggtctgtccagtttgtttcagaatctcggggtgtccgtaacaccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcggga

SEQ ID NO: 81 - protein, 172 aa, Artificial Sequence
  Description of Artificial Sequence: Synthetic polypeptide
MVFTLEDFVGDWRQTAGYNLDQVLEQGGLSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAG

SEQ ID NO: 82 - DNA, 516 bp, Artificial Sequence
  Description of Artificial Sequence: Synthetic polynucleotide
atggtgtttacactcgaagatttcgtaggggactggcggcagacagccggctacaacctggatcaagtccttgagcagggcggtctgtccagtttgtttcagaatctcggggtgtccgtaacaccgatccaaaagattgtcctgagcggtgaaaacggcctgaagatcgacatccatgtcatcatcccgtatgaaggtctgaacggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcggga

SEQ ID NO: 83 - protein, 172 aa, Artificial Sequence
  Description of Artificial Sequence: Synthetic polypeptide
MVFTLEDFVGDWRQTAGYNLDQVLEQGGLSSLFQNLGVSVTPIQKIVLSGENGLKIDIHVIIPYEGLNGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAG

SEQ ID NO: 84 - DNA, 1866 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggtgtttacactcgaagatttcgtaggggactggcggcagacagccggctacaacctggaccaagtccttgagcagggcggtctgtccagtttgtttcagaatctcggggtgtccgtaacaccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggag

SEQ ID NO: 85 - protein, 625 aa, Artificial Sequence
  Description of Artificial Sequence: Synthetic polypeptide
MLGLSEQSVSISRCAGTRLPALLDEQQVNVLLYDMNGCYSRLKELVPTLPQNRKVSKVEILQHVIDYIRDLQLELNSESEVGTTGGRGLPVRAPLSTLNGEISALAAEAACVPADDRILCRVSLENLYFQASGGGGGAIAMVFTLEDFVGDWRQTAGYNLDQVLEQGGLSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 86 - DNA, 1875 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggtgtttacactcgaagatttcgtaggggactggcggcagacagccggctacaacctggatcaagtccttgagcagggcggtctgtccagtttgtttcagaatctcggggtgtccgtaacaccgatccaaaagattgtcctgagcggtgaaaacggcctgaagatcgacatccatgtcatcatcccgtatgaaggtctgaacggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 87 - protein, 625 aa, Artificial Sequence
  Description of Artificial Sequence: Synthetic polypeptide
MLGLSEQSVSISRCAGTRLPALLDEQQVNVLLYDMNGCYSRLKELVPTLPQNRKVSKVEILQHVIDYIRDLQLELNSESEVGTTGGRGLPVRAPLSTLNGEISALAAEAACVPADDRILCRVSLENLYFQASGGGGGAIAMVFTLEDFVGDWRQTAGYNLDQVLEQGGLSSLFQNLGVSVTPIQKIVLSGENGLKIDIHVIIPYEGLNGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 88 - DNA, 513 bp, Artificial Sequence
  Description of Artificial Sequence: Synthetic polynucleotide
atggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcg

SEQ ID NO: 89 - protein, 171 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 90 - DNA, 1875 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 91 - protein, 625 aa, Artificial Sequence
  Description of Artificial Sequence: Synthetic polypeptide
MLGLSEQSVSISRCAGTRLPALLDEQQVNVLLYDMNGCYSRLKELVPTLPQNRKVSKVEILQHVIDYIRDLQLELNSESEVGTTGGRGLPVRAPLSTLNGEISALAAEAACVPADDRILCRVSLENLYFQASGGGGGAIAMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGYLEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 92 - DNA, 513 bp, Artificial Sequence
  Description of Artificial Sequence: Synthetic polynucleotide
atggtgtttacactcgaagatttcgtaggggactggcggcagacagccggctacaacctggaccaagtccttgagcagggcggtctgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcg

SEQ ID NO: 93 - protein, 171 aa, Artificial Sequence
  Description of Artificial Sequence: Synthetic polypeptide
MVFTLEDFVGDWRQTAGYNLDQVLEQGGLSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 94 - DNA, 1875 bp, Artificial Sequence
  Description of Artificial Sequence: Synthetic polynucleotide
atgcttggtctgtcggagcaaagcgtgtccatctcgcgctgcgctgggacgcgcctgcccgccttgctggacgagcagcaggtgaacgtcctgctctacgacatgaacggctgctactcacgcctcaaggagctggtgcccaccctgccccagaaccgcaaagtgagcaaggtggagatcctgcagcatgtaatcgactacatcagggacctgcagctggagctgaactcggagtctgaagtcgggaccaccggaggccggggactgcctgtccgcgccccgctcagcaccctgaacggcgagatcagtgccttggcggccgaggcggcatgtgttccagccgacgatcgcatcttgtgtcgcgtttctcttgagaatctttattttcaggcgtctggaggtggtggcggagcgatcgccatggtgtttacactcgaagatttcgtaggggactggcggcagacagccggctacaacctggaccaagtccttgagcagggcggtctgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggatatctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggt

SEQ ID NO: 95 - protein, 625 aa, Artificial Sequence; identical to SEQ ID NO: 85
  Description of Artificial Sequence: Synthetic polypeptide

SEQ ID NO: 96 - DNA, 87 bp, Unknown
  Description of Unknown: cAMP-response element (CRE) oligonucleotide
gcaccagacagtgacgtcagctgccagatcccatggccgtcatactgtgacgtctttcagacaccccttgacgtcaatgggagaaca

SEQ ID NO: 97 - DNA, 516 bp, Artificial Sequence
  Description of Artificial Sequence: Synthetic polynucleotide
atggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtg

SEQ ID NO: 98 - protein, 172 aa, Artificial Sequence
  Description of Artificial Sequence: Synthetic polypeptide
MDDHHFKVILHYGTLVIDGVTPNMIDYFGRPYEGIAVFDGKKITVTGTLWNGNKIIDERLINPDGSLLFRVTINGVTGWRLCERILAMVFTLEDFVGDWRQTAGYNLDQVLEQGGVSSLFQNLGVSVTPIQRIVLSGENGLKIDIHVIIPYEGLSGDQMGQIEKIFKVVYPV

SEQ ID NO: 99 - DNA, 531 bp, Artificial Sequence
  Description of Artificial Sequence: Synthetic polynucleotide
atggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcggggagctccggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtg

SEQ ID NO: 100 - protein, 177 aa, Artificial Sequence
  Description of Artificial Sequence: Synthetic polypeptide
MDDHHFKVILHYGTLVIDGVTPNMIDYFGRPYEGIAVFDGKKITVTGTLWNGNKIIDERLINPDGSLLFRVTINGVTGWRLCERILAGSSGGMVFTLEDFVGDWRQTAGYNLDQVLEQGGVSSLFQNLGVSVTPIQRIVLSGENGLKIDIHVIIPYEGLSGDQMGQIEKIFKVVYPV

SEQ ID NO: 101 - DNA, 546 bp, Artificial Sequence
  Description of Artificial Sequence: Synthetic polynucleotide
atggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggagggagctccggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtg

SEQ ID NO: 102 - protein, 182 aa, Artificial Sequence
  Description of Artificial Sequence: Synthetic polypeptide
MDDHHFKVILHYGTLVIDGVTPNMIDYFGRPYEGIAVFDGKKITVTGTLWNGNKIIDERLINPDGSLLFRVTINGVTGWRLCERILAGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPV

SEQ ID NO: 103 - DNA, 576 bp, Artificial Sequence
  Description of Artificial Sequence: Synthetic polynucleotide
atggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggagggagctccggtggaggaagttctggtggagggagctccggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtg

SEQ ID NO: 104 - protein, 192 aa, Artificial Sequence
  Description of Artificial Sequence: Synthetic polypeptide
MDDHHFKVILHYGTLVIDGVTPNMIDYFGRPYEGIAVFDGKKITVTGTLWNGNKIIDERLINPDGSLLFRVTINGVTGWRLCERILAGSSGGGSSGGGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPV

SEQ ID NO: 105 - DNA, 516 bp, Artificial Sequence
  Description of Artificial Sequence: Synthetic polynucleotide
atgggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactat

SEQ ID NO: 106 - protein, 172 aa, Artificial Sequence
  Description of Artificial Sequence: Synthetic polypeptide
MGTLVIDGVTPNMIDYFGRPYEGIAVFDGKKITVTGTLWNGNKIIDERLINPDGSLLFRVTINGVTGWRLCERILAMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHY

SEQ ID NO: 107 - DNA, 531 bp, Artificial Sequence
  Description of Artificial Sequence: Synthetic polynucleotide
atgggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcggggagctccggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactat

SEQ ID NO: 108 - protein, 177 aa, Artificial Sequence
  Description of Artificial Sequence: Synthetic polypeptide
MGTLVIDGVTPNMIDYFGRPYEGIAVFDGKKITVTGTLWNGNKIIDERLINPDGSLLFRVTINGVTGWRLCERILAGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHY

SEQ ID NO: 109 - DNA, 546 bp, Artificial Sequence
  Description of Artificial Sequence: Synthetic polynucleotide
atgggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggagggagctccggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactat

SEQ ID NO: 110 - protein, 182 aa, Artificial Sequence
  Description of Artificial Sequence: Synthetic polypeptide
MGTLVIDGVTPNMIDYFGRPYEGIAVFDGKKITVTGTLWNGNKIIDERLINPDGSLLFRVTINGVTGWRLCERILAGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHY

SEQ ID NO: 111 - DNA, 576 bp, Artificial Sequence
  Description of Artificial Sequence: Synthetic polynucleotide
atgggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggagggagctccggtggaggaagttctggtggagggagctccggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactat

SEQ ID NO: 112 - protein, 192 aa, Artificial Sequence
  Description of Artificial Sequence: Synthetic polypeptide
MGTLVIDGVTPNMIDYFGRPYEGIAVFDGKKITVTGTLWNGNKIIDERLINPDGSLLFRVTINGVTGWRLCERILAGSSGGGSSGGGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHY

SEQ ID NO: 113 - protein, 5 aa, Artificial Sequence
  Description of Artificial Sequence: Synthetic peptide
GSSGG

SEQ ID NO: 114 - DNA, 615 bp, Artificial Sequence
  Description of Artificial Sequence: Synthetic polynucleotide
atggatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaa

SEQ ID NO: 115 - protein, 205 aa, Artificial Sequence
  Description of Artificial Sequence: Synthetic polypeptide
MDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLE

SEQ ID NO: 116 - DNA, 615 bp, Artificial Sequence
  Description of Artificial Sequence: Synthetic polynucleotide
atgttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagat

SEQ ID NO: 117 - protein, 205 aa, Artificial Sequence
  Description of Artificial Sequence: Synthetic polypeptide
MFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLED

SEQ ID NO: 118 - DNA, 615 bp, Artificial Sequence
  Description of Artificial Sequence: Synthetic polynucleotide
atggtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttc

SEQ ID NO: 119 - protein, 205 aa, Artificial Sequence
  Description of Artificial Sequence: Synthetic polypeptide
MVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDF

SEQ ID NO: 120 - DNA, 615 bp, Artificial Sequence
  Description of Artificial Sequence: Synthetic polynucleotide
atggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggg

SEQ ID NO: 121 - protein, 205 aa, Artificial Sequence
  Description of Artificial Sequence: Synthetic polypeptide
MDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVG

SEQ ID NO: 122 - DNA, 615 bp, Artificial Sequence
  Description of Artificial Sequence: Synthetic polynucleotide
atgcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactgg

SEQ ID NO: 123 - protein, 205 aa, Artificial Sequence
  Description of Artificial Sequence: Synthetic polypeptide
MRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDW

SEQ ID NO: 124 - DNA, 603 bp, Artificial Sequence
  Description of Artificial Sequence: Synthetic polynucleotide
cagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggg

SEQ ID NO: 125 - protein, 201 aa, Artificial Sequence
  Description of Artificial Sequence: Synthetic polypeptide
QTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVG

SEQ ID NO: 126 - DNA, 615 bp, Artificial Sequence
  Description of Artificial Sequence: Synthetic polynucleotide
atgggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagcc

SEQ ID NO: 127 - protein, 205 aa, Artificial Sequence
  Description of Artificial Sequence: Synthetic polypeptide
MGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTA

SEQ ID NO: 128 - DNA, 612 bp, Artificial Sequence
  Description of Artificial Sequence: Synthetic polynucleotide
ctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaac

SEQ ID NO: 129 - protein, 204 aa, Artificial Sequence
  Description of Artificial Sequence: Synthetic polypeptide
LDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYN

SEQ ID NO: 130 - DNA, 612 bp, Artificial Sequence
  Description of Artificial Sequence: Synthetic polynucleotide
gtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaa

SEQ ID NO: 131 - protein, 204 aa, Artificial Sequence
  Description of Artificial Sequence: Synthetic polypeptide
VLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQ

SEQ ID NO: 132 - DNA, 612 bp, Artificial Sequence
  Description of Artificial Sequence: Synthetic polynucleotide
cagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgag

SEQ ID NO: 133 - protein, 204 aa, Artificial Sequence
  Description of Artificial Sequence: Synthetic polypeptide
QGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLE

SEQ ID NO: 134 - DNA, 612 bp, Artificial Sequence
  Description of Artificial Sequence: Synthetic polynucleotide
gtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggt

SEQ ID NO: 135 - protein, 204 aa, Artificial Sequence
  Description of Artificial Sequence: Synthetic polypeptide
VSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGG

SEQ ID NO: 136 - DNA, 615 bp, Artificial Sequence
  Description of Artificial Sequence: Synthetic polynucleotide
atgctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaat

SEQ ID NO: 137 - protein, 205 aa, Artificial Sequence
  Description of Artificial Sequence: Synthetic polypeptide
MLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQN

SEQ ID NO: 138 - DNA, 615 bp, Artificial Sequence
  Description of Artificial Sequence: Synthetic polynucleotide
atgccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaact

SEQ ID NO: 139 - protein, 205 aa, Artificial Sequence
  Description of Artificial Sequence: Synthetic polypeptide
MPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVT

SEQ ID NO: 140 - DNA, 615 bp, Artificial Sequence
  Description of Artificial Sequence: Synthetic polynucleotide
atgaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaa

SEQ ID NO: 141 - protein, 205 aa, Artificial Sequence
  Description of Artificial Sequence: Synthetic polypeptide
MRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQ

SEQ ID NO: 142 - DNA, 615 bp, Artificial Sequence
  Description of Artificial Sequence: Synthetic polynucleotide
atgattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaagg

SEQ ID NO: 143 - protein, 205 aa, Artificial Sequence
  Description of Artificial Sequence: Synthetic polypeptide
MIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQR

SEQ ID NO: 144 - DNA, 615 bp, Artificial Sequence
  Description of Artificial Sequence: Synthetic polynucleotide
atggtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggatt

SEQ ID NO: 145 - protein, 205 aa, Artificial Sequence
  Description of Artificial Sequence: Synthetic polypeptide
MVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRI

SEQ ID NO: 146 - DNA, 612 bp, Artificial Sequence
  Description of Artificial Sequence: Synthetic polynucleotide
atgctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggatt

SEQ ID NO: 147 - protein, 204 aa, Artificial Sequence
  Description of Artificial Sequence: Synthetic polypeptide
MLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRI

SEQ ID NO: 148 - DNA, 615 bp, Artificial Sequence
  Description of Artificial Sequence: Synthetic polynucleotide
atgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctg

SEQ ID NO: 149 - protein, 205 aa, Artificial Sequence
  Description of Artificial Sequence: Synthetic polypeptide
MSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVL

SEQ ID NO: 150 - DNA, 616 bp, Artificial Sequence
  Description of Artificial Sequence: Synthetic polynucleotide
atgggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcg

SEQ ID NO: 151 - protein, 205 aa, Artificial Sequence
  Description of Artificial Sequence: Synthetic polypeptide
MGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLS

SEQ ID NO: 152 - DNA, 615 bp, Artificial Sequence
  Description of Artificial Sequence: Synthetic polynucleotide
atggaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggt

SEQ ID NO: 153 - protein, 205 aa, Artificial Sequence
  Description of Artificial Sequence: Synthetic polypeptide
MENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSG

SEQ ID NO: 154 - DNA, 615 bp, Artificial Sequence
  Description of Artificial Sequence: Synthetic polynucleotide
atgaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaa

SEQ ID NO: 155 - protein, 205 aa, Artificial Sequence
  Description of Artificial Sequence: Synthetic polypeptide
MNGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGE

SEQ ID NO: 156 - DNA, 615 bp, Artificial Sequence
  Description of Artificial Sequence: Synthetic polynucleotide
atgggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaac

SEQ ID NO: 157 - protein, 205 aa, Artificial Sequence
  Description of Artificial Sequence: Synthetic polypeptide
MGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGEN

SEQ ID NO: 158 - DNA, 615 bp, Artificial Sequence
  Description of Artificial Sequence: Synthetic polynucleotide
atgctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggc

SEQ ID NO: 159 - protein, 205 aa, Artificial Sequence
  Description of Artificial Sequence: Synthetic polypeptide
MLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENG

SEQ ID NO: 160 - DNA, 615 bp, Artificial Sequence
  Description of Artificial Sequence: Synthetic polynucleotide
atgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctg

SEQ ID NO: 161 - protein, 205 aa, Artificial Sequence
  Description of Artificial Sequence: Synthetic polypeptide
MKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGL

SEQ ID NO: 162 - DNA, 615 bp, Artificial Sequence
  Description of Artificial Sequence: Synthetic polynucleotide
atgatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaag

SEQ ID NO: 163 - protein, 205 aa, Artificial Sequence
  Description of Artificial Sequence: Synthetic polypeptide
MIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLK

SEQ ID NO: 164 - DNA, 615 bp, Artificial Sequence
  Description of Artificial Sequence: Synthetic polynucleotide
atggacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatc

SEQ ID NO: 165 - protein, 205 aa, Artificial Sequence
  Description of Artificial Sequence: Synthetic polypeptide
MDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKI

SEQ ID NO: 166 - DNA, 614 bp, Artificial Sequence
  Description of Artificial Sequence: Synthetic polynucleotide
atgatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcga

SEQ ID NO: 167 - protein, 205 aa, Artificial Sequence
  Description of Artificial Sequence: Synthetic polypeptide
MIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKID

SEQ ID NO: 168 - DNA, 615 bp, Artificial Sequence
  Description of Artificial Sequence: Synthetic polynucleotide
atggtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccat

SEQ ID NO: 169 - protein, 205 aa, Artificial Sequence
  Description of Artificial Sequence: Synthetic polypeptide
MVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIH

SEQ ID NO: 170 - DNA, 615 bp, Artificial Sequence
  Description of Artificial Sequence: Synthetic polynucleotide
atgggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaa

SEQ ID NO: 171 - protein, 205 aa, Artificial Sequence
  Description of Artificial Sequence: Synthetic polypeptide
MGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYE

SEQ ID NO: 172 - DNA, 615 bp, Artificial Sequence
  Description of Artificial Sequence: Synthetic polynucleotide
atgggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagc

SEQ ID NO: 173 - protein, 205 aa, Artificial Sequence
  Description of Artificial Sequence: Synthetic polypeptide
MGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLS

SEQ ID NO: 174 - DNA, 615 bp, Artificial Sequence
  Description of Artificial Sequence: Synthetic polynucleotide
atgatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcag

SEQ ID NO: 175 - protein, 205 aa, Artificial Sequence
  Description of Artificial Sequence: Synthetic polypeptide
MMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQ

SEQ ID NO: 176 - DNA, 615 bp, Artificial Sequence
  Description of Artificial Sequence: Synthetic polynucleotide
atgatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccag

SEQ ID NO: 177 - protein, 205 aa, Artificial Sequence
  Description of Artificial Sequence: Synthetic polypeptide
MIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQ

SEQ ID NO: 178 - DNA, 615 bp, Artificial Sequence
  Description of Artificial Sequence: Synthetic polynucleotide
atgatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaa

SEQ ID NO: 179 - protein, 205 aa, Artificial Sequence
  Description of Artificial Sequence: Synthetic polypeptide
MIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEK

SEQ ID NO: 180 - DNA, 615 bp, Artificial Sequence
  Description of Artificial Sequence: Synthetic polynucleotide
atggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaag

SEQ ID NO: 181 - protein, 205 aa, Artificial Sequence
  Description of Artificial Sequence: Synthetic polypeptide
MVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFK

SEQ ID NO: 182 - DNA, 615 bp, Artificial Sequence
  Description of Artificial Sequence: Synthetic polynucleotide
atggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtg

SEQ ID NO: 183 - protein, 205 aa, Artificial Sequence
  Description of Artificial Sequence: Synthetic polypeptide
MVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKV

SEQ ID NO: 184 - DNA, 615 bp, Artificial Sequence
  Description of Artificial Sequence: Synthetic polynucleotide
atgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtg

SEQ ID NO: 185 - protein, 205 aa, Artificial Sequence
  Description of Artificial Sequence: Synthetic polypeptide
MYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVV

SEQ ID NO: 186 - DNA, 615 bp, Artificial Sequence
  Description of Artificial Sequence: Synthetic polynucleotide
atgcctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtac

SEQ ID NO: 187 - protein, 205 aa, Artificial Sequence
  Description of Artificial Sequence: Synthetic polypeptide
MPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVY

SEQ ID NO: 188 - DNA, 615 bp, Artificial Sequence
  Description of Artificial Sequence: Synthetic polynucleotide
atggtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccct

SEQ ID NO: 189 - protein, 205 aa, Artificial Sequence
  Description of Artificial Sequence: Synthetic polypeptide
MVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYP

SEQ ID NO: 190 - DNA, 615 bp, Artificial Sequence
  Description of Artificial Sequence: Synthetic polynucleotide
atggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtg

SEQ ID NO: 191 - protein, 205 aa, Artificial Sequence
  Description of Artificial Sequence: Synthetic polypeptide
MDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPV

SEQ ID NO: 192 - DNA, 615 bp, Artificial Sequence
  Description of Artificial Sequence: Synthetic polynucleotide
atggatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggat

SEQ ID NO: 193 - protein, 205 aa, Artificial Sequence
  Description of Artificial Sequence: Synthetic polypeptide
MDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVD

SEQ ID NO: 194 - DNA, 615 bp, Artificial Sequence
  Description of Artificial Sequence: Synthetic polynucleotide
atgcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgat

SEQ ID NO: 195 - protein, 205 aa, Artificial Sequence
  Description of Artificial Sequence: Synthetic polypeptide
MHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDD

SEQ ID NO: 196 - DNA, 615 bp, Artificial Sequence
  Description of Artificial Sequence: Synthetic polynucleotide
atgcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcat

SEQ ID NO: 197 - protein, 205 aa, Artificial Sequence
  Description of Artificial Sequence: Synthetic polypeptide
MHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDH

SEQ ID NO: 198 - DNA, 615 bp, Artificial Sequence
  Description of Artificial Sequence: Synthetic polynucleotide
atgtttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcac

SEQ ID NO: 199 - protein, 205 aa, Artificial Sequence
  Description of Artificial Sequence: Synthetic polypeptide
MFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHH

SEQ ID NO: 200 - DNA, 615 bp, Artificial Sequence
  Description of Artificial Sequence: Synthetic polynucleotide
atgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtg

SEQ ID NO: 201 - protein, 205 aa, Artificial Sequence
  Description of Artificial Sequence: Synthetic polypeptide
MILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKV

SEQ ID NO: 202 - DNA, 616 bp, Artificial Sequence
  Description of Artificial Sequence: Synthetic polynucleotide
atgtatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcacg

SEQ ID NO: 203 - protein, 205 aa, Artificial Sequence
  Description of Artificial Sequence: Synthetic polypeptide
MYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILH

SEQ ID NO: 204 - DNA, 615 bp, Artificial Sequence
  Description of Artificial Sequence: Synthetic polynucleotide
atgggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactat

SEQ ID NO: 205 - protein, 205 aa, Artificial Sequence
  Description of Artificial Sequence: Synthetic polypeptide
MGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHY

SEQ ID NO: 206 - DNA, 615 bp, Artificial Sequence
  Description of Artificial Sequence: Synthetic polynucleotide
atgctggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcaca

SEQ ID NO: 207 - protein, 205 aa, Artificial Sequence
  Description of Artificial Sequence: Synthetic polypeptide
MLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGT

SEQ ID NO: 208 - DNA, 615 bp, Artificial Sequence
  Description of Artificial Sequence: Synthetic polynucleotide
atggacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatc

SEQ ID NO: 209 - protein, 205 aa, Artificial Sequence
  Description of Artificial Sequence: Synthetic polypeptide
MDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVI

SEQ ID NO: 210 - DNA, 615 bp, Artificial Sequence
  Description of Artificial Sequence: Synthetic polynucleotide
atgggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgac

SEQ ID NO: 211 - protein, 205 aa, Artificial Sequence
  Description of Artificial Sequence: Synthetic polypeptide
MGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVID

SEQ ID NO: 212 - DNA, 615 bp, Artificial Sequence
  Description of Artificial Sequence: Synthetic polynucleotide
atggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggg

SEQ ID NO: 213 - protein, 205 aa, Artificial Sequence
  Description of Artificial Sequence: Synthetic polypeptide
MVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDG

SEQ ID NO: 214 - DNA, 615 bp, Artificial Sequence
  Description of Artificial Sequence: Synthetic polynucleotide
atgacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggtt

SEQ ID NO: 215 - protein, 205 aa, Artificial Sequence
  Description of Artificial Sequence: Synthetic polypeptide
MTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGV

SEQ ID NO: 216 - DNA, 615 bp, Artificial Sequence
  Description of Artificial Sequence: Synthetic polynucleotide
atgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacg

SEQ ID NO: 217 - protein, 205 aa, Artificial Sequence
  Description of Artificial Sequence: Synthetic polypeptide
MPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVT

SEQ ID NO: 218 - DNA, 612 bp, Artificial Sequence
  Description of Artificial Sequence: Synthetic polynucleotide
atgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacg

SEQ ID NO: 219 - protein, 204 aa, Artificial Sequence
  Description of Artificial Sequence: Synthetic polypeptide
MNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVT

SEQ ID NO: 220 - DNA, 615 bp, Artificial Sequence
  Description of Artificial Sequence: Synthetic polynucleotide
atgatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaac

SEQ ID NO: 221 - protein, 205 aa, Artificial Sequence
  Description of Artificial Sequence: Synthetic polypeptide
MMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPN

SEQ ID NO: 222 - DNA, 615 bp, Artificial Sequence
  Description of Artificial Sequence: Synthetic polynucleotide
atgtatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgac

SEQ ID NO: 223 - protein, 205 aa, Artificial Sequence
  Description of Artificial Sequence: Synthetic polypeptide
MYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMID

SEQ ID NO: 224 - DNA, 615 bp, Artificial Sequence
  Description of Artificial Sequence: Synthetic polynucleotide
atgcggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcgga

SEQ ID NO: 225 - protein, 205 aa, Artificial Sequence
  Description of Artificial Sequence: Synthetic polypeptide
MRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFG

SEQ ID NO: 226 - DNA, 615 bp, Artificial Sequence
  Description of Artificial Sequence: Synthetic polynucleotide
atggaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtat

SEQ ID NO: 227 - protein, 205 aa, Artificial Sequence
  Description of Artificial Sequence: Synthetic polypeptide
MEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPY

SEQ ID NO: 228 - DNA, 615 bp, Artificial Sequence
  Description of Artificial Sequence: Synthetic polynucleotide
atgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgtggcc

SEQ ID NO: 229 - protein, 205 aa, Artificial Sequence
  Description of Artificial Sequence: Synthetic polypeptide
MFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIVA

SEQ ID NO: 230 - DNA, 615 bp, Artificial Sequence
  Description of Artificial Sequence: Synthetic polynucleotide
atggacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttc

SEQ ID NO: 231 - protein, 205 aa, Artificial Sequence
  Description of Artificial Sequence: Synthetic polypeptide
MDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVF

SEQ ID NO: 232 - DNA, 615 bp, Artificial Sequence
  Description of Artificial Sequence: Synthetic polynucleotide
atgaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggc

SEQ ID NO: 233 - protein, 205 aa, Artificial Sequence
  Description of Artificial Sequence: Synthetic polypeptide
MKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDG

SEQ ID NO: 234 - DNA, 615 bp, Artificial Sequence
  Description of Artificial Sequence: Synthetic polynucleotide
atgaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaa

SEQ ID NO: 235 - protein, 205 aa, Artificial Sequence
  Description of Artificial Sequence: Synthetic polypeptide
MKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGK

SEQ ID NO: 236 - DNA, 615 bp, Artificial Sequence
  Description of Artificial Sequence: Synthetic polynucleotide
atgatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaag

SEQ ID NO: 237 - protein, 205 aa, Artificial Sequence
  Description of Artificial Sequence: Synthetic polypeptide
MITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKK

SEQ ID NO: 238 - DNA, 615 bp, Artificial Sequence
  Description of Artificial Sequence: Synthetic polynucleotide
atggggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaacc

SEQ ID NO: 239 - protein, 205 aa, Artificial Sequence
  Description of Artificial Sequence: Synthetic polypeptide
MGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVT

SEQ ID NO: 240 - DNA, 615 bp, Artificial Sequence
  Description of Artificial Sequence: Synthetic polynucleotide
atgaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccggg

SEQ ID NO: 241 - protein, 205 aa, Artificial Sequence
  Description of Artificial Sequence: Synthetic polypeptide
MTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTG

SEQ ID NO: 242 - DNA, 615 bp, Artificial Sequence
  Description of Artificial Sequence: Synthetic polynucleotide
atgctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggacc

SEQ ID NO: 243 - protein, 205 aa, Artificial Sequence
  Description of Artificial Sequence: Synthetic polypeptide
MLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGT

SEQ ID NO: 244 - DNA, 616 bp, Artificial Sequence
  Description of Artificial Sequence: Synthetic polynucleotide
atgaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggg

SEQ ID NO: 245 - protein, 205 aa, Artificial Sequence
  Description of Artificial Sequence: Synthetic polypeptide
MNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLW

SEQ ID NO: 246 - DNA, 615 bp, Artificial Sequence
  Description of Artificial Sequence: Synthetic polynucleotide
atgaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaac

SEQ ID NO: 247 - protein, 205 aa, Artificial Sequence
  Description of Artificial Sequence: Synthetic polypeptide
MKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGN

SEQ ID NO: 248 - DNA, 624 bp, Artificial Sequence
  Description of Artificial Sequence: Synthetic polynucleotide
atggacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgc

SEQ ID NO: 249 - protein, 208 aa, Artificial Sequence
  Description of Artificial Sequence: Synthetic polypeptide
MDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDER

SEQ ID NO: 250 - DNA, 615 bp, Artificial Sequence
  Description of Artificial Sequence: Synthetic polynucleotide
atggagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgac

SEQ ID NO: 251 - protein, 205 aa, Artificial Sequence
  Description of Artificial Sequence: Synthetic polypeptide
MERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIID

SEQ ID NO: 252 - DNA, 615 bp, Artificial Sequence
  Description of Artificial Sequence: Synthetic polynucleotide
atgcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgag

SEQ ID NO: 253 - protein, 205 aa, Artificial Sequence
  Description of Artificial Sequence: Synthetic polypeptide
MRLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDE

SEQ ID NO: 254 - DNA, 615 bp, Artificial Sequence
  Description of Artificial Sequence: Synthetic polynucleotide
atgctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgc

SEQ ID NO: 255 - protein, 205 aa, Artificial Sequence
  Description of Artificial Sequence: Synthetic polypeptide
MLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDER

SEQ ID NO: 256 - DNA, 615 bp, Artificial Sequence
  Description of Artificial Sequence: Synthetic polynucleotide
atgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctg

SEQ ID NO: 257 - protein, 205 aa, Artificial Sequence
  Description of Artificial Sequence: Synthetic polypeptide
MINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERL

SEQ ID NO: 258 - DNA, 615 bp, Artificial Sequence
  Description of Artificial Sequence: Synthetic polynucleotide
atgaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatc

SEQ ID NO: 259 - protein, 205 aa, Artificial Sequence
  Description of Artificial Sequence: Synthetic polypeptide
MNPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLI

SEQ ID NO: 260 - DNA, 615 bp, Artificial Sequence
  Description of Artificial Sequence: Synthetic polynucleotide
atgcccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaac

SEQ ID NO: 261 - protein, 205 aa, Artificial Sequence
  Description of Artificial Sequence: Synthetic polypeptide
MPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLIN

SEQ ID NO: 262 - DNA, 615 bp, Artificial Sequence
  Description of Artificial Sequence: Synthetic polynucleotide
atggacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaacccc

SEQ ID NO: 263 - protein, 205 aa, Artificial Sequence
  Description of Artificial Sequence: Synthetic polypeptide
MDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINP

SEQ ID NO: 264 - DNA, 615 bp, Artificial Sequence
  Description of Artificial Sequence: Synthetic polynucleotide
atgggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgac

SEQ ID NO: 265 - protein, 205 aa, Artificial Sequence
  Description of Artificial Sequence: Synthetic polypeptide
MGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPD

SEQ ID NO: 266 - DNA, 615 bp, Artificial Sequence
  Description of Artificial Sequence: Synthetic polynucleotide
atgtccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggc

SEQ ID NO: 267 - protein, 205 aa, Artificial Sequence
  Description of Artificial Sequence: Synthetic polypeptide
MSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDG

SEQ ID NO: 268 - DNA, 615 bp, Artificial Sequence
  Description of Artificial Sequence: Synthetic polynucleotide
atgctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctcc

SEQ ID NO: 269 - protein, 205 aa, Artificial Sequence
  Description of Artificial Sequence: Synthetic polypeptide
MLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGS

SEQ ID NO: 270 - DNA, 615 bp, Artificial Sequence
  Description of Artificial Sequence: Synthetic polynucleotide
atgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctg

SEQ ID NO: 271 - protein, 205 aa, Artificial Sequence
  Description of Artificial Sequence: Synthetic polypeptide
MLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSL

SEQ ID NO: 272 - DNA, 615 bp, Artificial Sequence
  Description of Artificial Sequence: Synthetic polynucleotide
atgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctg

SEQ ID NO: 273 - protein, 205 aa, Artificial Sequence
  Description of Artificial Sequence: Synthetic polypeptide
MFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLL

SEQ ID NO: 274 - DNA, 615 bp, Artificial Sequence
  Description of Artificial Sequence: Synthetic polynucleotide
atgaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgta

SEQ ID NO: 275 - protein, 205 aa, Artificial Sequence
  Description of Artificial Sequence: Synthetic polypeptide
MTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRV

SEQ ID NO: 276 - DNA, 615 bp, Artificial Sequence
  Description of Artificial Sequence: Synthetic polynucleotide
atgaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatc

SEQ ID NO: 277 - protein, 205 aa, Artificial Sequence
  Description of Artificial Sequence: Synthetic polypeptide
MNGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTI

SEQ ID NO: 278 - DNA, 615 bp, Artificial Sequence
  Description of Artificial Sequence: Synthetic polynucleotide
atgggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaac

SEQ ID NO: 279 - protein, 205 aa, Artificial Sequence
  Description of Artificial Sequence: Synthetic polypeptide
MGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTIN

SEQ ID NO: 280 - DNA, 615 bp, Artificial Sequence
  Description of Artificial Sequence: Synthetic polynucleotide
atggtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacgga

SEQ ID NO: 281 - protein, 205 aa, Artificial Sequence
  Description of Artificial Sequence: Synthetic polypeptide
MVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTING

SEQ ID NO: 282 - DNA, 615 bp, Artificial Sequence
  Description of Artificial Sequence: Synthetic polynucleotide
atgggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgacc

SEQ ID NO: 283 - protein, 205 aa, Artificial Sequence
  Description of Artificial Sequence: Synthetic polypeptide
MGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVT

SEQ ID NO: 284 - DNA, 615 bp, Artificial Sequence
  Description of Artificial Sequence: Synthetic polynucleotide
atgctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcgg

SEQ ID NO: 285 - protein, 205 aa, Artificial Sequence
  Description of Artificial Sequence: Synthetic polypeptide
MLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWR

SEQ ID NO: 286 - DNA, 615 bp, Artificial Sequence
  Description of Artificial Sequence: Synthetic polynucleotide
atgcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgag

SEQ ID NO: 287 - protein, 205 aa, Artificial Sequence
  Description of Artificial Sequence: Synthetic polypeptide
MRILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCE

SEQ ID NO: 288 - DNA, 389 bp, Artificial Sequence
  Description of Artificial Sequence: Synthetic polynucleotide
gagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtggagtgaccggctggcggctgtgcgaacgcattctggcg

SEQ ID NO: 289 - protein, 130 aa, Artificial Sequence
  Description of Artificial Sequence: Synthetic polypeptide
GVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGGVTGWRLCERILA

SEQ ID NO: 290 - DNA, 795 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 291 - protein, 265 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 292 - DNA, 825 bp, Artificial Sequence
  Description of Artificial Sequence: Synthetic polynucleotide
ggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaac

SEQ ID NO: 293 - protein, 275 aa, Artificial Sequence
  Description of Artificial Sequence: Synthetic polypeptide
GVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTIN

SEQ ID NO: 294 - DNA, 354 bp, Artificial Sequence
  Description of Artificial Sequence: Synthetic polynucleotide
atgggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 295 - protein, 118 aa, Artificial Sequence
  Description of Artificial Sequence: Synthetic polypeptide
MGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 296 - DNA, 554 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggc

SEQ ID NO: 297 - protein, 184 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGTPNMIDYFGRPYEGIAVFDGKKITVTGTLWNGNKIIDERLINPDGSLLFRVTINGVTGWRLCERIL

SEQ ID NO: 298 - DNA, 624 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 299 - protein, 184 aa, Artificial Sequence; identical to SEQ ID NO: 297
  Description of Artificial Sequence: Synthetic polypeptide

SEQ ID NO: 300 - DNA, 516 bp, Artificial Sequence
  Description of Artificial Sequence: Synthetic polynucleotide
atgacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 301 - protein, 172 aa, Artificial Sequence
  Description of Artificial Sequence: Synthetic polypeptide
MTPNMIDYFGRPYEGIAVFDGKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 302 - DNA, 666 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggtt

SEQ ID NO: 303 - protein, 222 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGV

SEQ ID NO: 304 - DNA, 612 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtgatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 305 - protein, 204 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 306 - DNA, 567 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 307 - protein, 189 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 308 - DNA, 255 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtg

SEQ ID NO: 309 - protein, 85 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPV

SEQ ID NO: 310 - DNA, 261 bp, Artificial Sequence
  Description of Artificial Sequence: Synthetic polynucleotide
atggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 311 - protein, 87 aa, Artificial Sequence
  Description of Artificial Sequence: Synthetic polypeptide
MDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 312 - DNA, 609 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtg

SEQ ID NO: 313 - protein, 203 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPV

SEQ ID NO: 314 - DNA, 573 bp, Artificial Sequence
  Description of Artificial Sequence: Synthetic polynucleotide
atggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 315 - protein, 191 aa, Artificial Sequence
  Description of Artificial Sequence: Synthetic polypeptide
MDDHHFKVILHYGTLVIDGVTPNMIDYFGRPYEGIAVFDGKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 316 - DNA, 2838 bp, Artificial Sequence
  Description of Artificial Sequence: Synthetic polynucleotide
atggcagaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtcgacgctcgagatttccggcgagccaaccactgaggatctgtactttcagagcgataacgcgatcgctttcgaaggagatagaaccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgttttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggcgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtaacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctgctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttacgtagtt

SEQ ID NO: 317 - DNA, 5064 bp, Artificial Sequence
  Description of Artificial Sequence: Synthetic polynucleotide
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctggtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtattaatacgactcactatagggctagcgatcgccatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagttctctcggtggttcaggtggtggcgggagcggtggagggagcagcggtggagtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgtaaggccgcgactctagagtcgacctgcaggcatgcaagctgatccggctgctaacaaagcccgaaaggaagctgagttggctgctgccaccgctgagcaataactagcataaccccttggggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggtttttttaagcaagtaaaacctctacaaatgtggtaaaatcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttaattaactgttgacaattaatcatcggcatagtatatcggcatagtataatacgacaaggtgaggaactaaacccaggaggcagatcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatcctctttgcgcttgcgttttcccttgtccagatagcccagtagctgacattcatccggggtcagcaccgtttctgcggactggctttctacccggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatttcaagaagatcctttgatcttttctacggggtctgacgctcagtggaacgaaaactcacgttaagggattttggtcatgagattatcaaaaaggatcttcacctagatccttttatagtccggaaatacaggaacgcacgctggatggcccttcgctgggatggtgaaaccatgaaaaatggcagcttcagtggattaagtgggggtaatgtggcctgtaccctctggttgcataggtattcatacggttaaaatttatcaggcgcgattgcggcagtttttcgggtggtttgttgccatttttacctgtctgctgccgtgatcgcgctgaacgcgttttagcggtgcgtacaattaagggattatggtaaatccacttactgtctgccctcgtagccatcgagataaaccgcagtactccggccacgatgcgtccggcgtagaggatcgagatct

SEQ ID NO: 318 - DNA, 513 bp, Artificial Sequence
  Description of Artificial Sequence: Synthetic polynucleotide
atggtcttcacactcgaagatttcgtaggtgactggcgacagacagccggctacaacctggaccaagtccttgaacagggtggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaactgggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 319 - DNA, 513 bp, Artificial Sequence
  Description of Artificial Sequence: Synthetic polynucleotide
atggtgtttacactcgaagatttcgtaggggactggcggcagacagccggctacaacctggaccaagtccttgaacagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcg

SEQ ID NO: 320 - DNA, 636 bp, Artificial Sequence
  Description of Artificial Sequence: Synthetic polynucleotide
atggtgtttacactcgaagatttcgtaggggactggcggcagacagccggctacaacctggaccaagtccttgaacagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgaattcacacggctttccgcccgaggttgaagagcaagccgccggtacattgcctatgtcctgcgcacaagaaagcggtatggaccggcacccagccgcttgtgcttcagctcgcatcaacgtc

SEQ ID NO: 321 - DNA, 597 bp, Artificial Sequence
  Description of Artificial Sequence: Synthetic polynucleotide
atgaactccttctccacaagcgccttcggtccagttgccttctccctgggcctgctcctggtgttgcctgctgccttccctgccccagtgtttacactcgaagatttcgtaggggactggcggcagacagccggctacaacctggaccaagtccttgaacagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcg

SEQ ID NO: 322 - DNA, 513 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 323 - DNA, 636 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgaattctcacggctttccgcctgaggttgaagagcaagccgccggtacattgcctatgtcctgcgcacaagaaagcggtatggaccggcacccagccgcttgtgcttcagctcgcatcaacgtc

SEQ ID NO: 324 - DNA, 597 bp, Artificial Sequence
  Description of Artificial Sequence: Synthetic polynucleotide
atgaactccttctccacaagcgccttcggtccagttgccttctccctgggcctgctcctggtgttgcctgctgccttccctgccccagtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 325 - DNA, 513 bp, Artificial Sequence
  Description of Artificial Sequence: Synthetic polynucleotide
atggtcttcacactcgaagatttcgtaggtgactggcgacagacagccggctacaacctggaccaagttcttgaacagggtggtgtgtccagtttgtttcagaatctcggggtgtccgtaactccaatccagaggatagtcctgagtggtgaaaatgggctgaagatcgacatccatgtcatcatcccttatgaaggtctgagcggcgatcagatggggcagatcgaaaaaatttttaaggtggtgtaccctgtggatgatcatcactttaaggtgatcctgcactatggcacactggtaatcgacggtgttacgccgaacatgatcgactatttcggacggccgtatgaaggcatcgccgtgttcgacggcaaaaagattactgtcactggaaccctgtggaatgggaacaaaattatcgacgagcgcctgatcaaccccgacggctcactgctgttccgagtaaccatcaatggtgttaccggctggcggctctgcgaacgcattctagca

SEQ ID NO: 326 - DNA, 636 bp, Artificial Sequence
  Description of Artificial Sequence: Synthetic polynucleotide
atggtcttcacactcgaagatttcgtaggtgactggcgacagacagccggctacaacctggaccaagttcttgaacagggtggtgtgtccagtttgtttcagaatctcggggtgtccgtaactccaatccagaggatagtcctgagtggtgaaaatgggctgaagatcgacatccatgtcatcatcccttatgaaggtctgagcggcgatcagatggggcagatcgaaaaaatttttaaggtggtgtaccctgtggatgatcatcactttaaggtgatcctgcactatggcacactggtaatcgacggtgttacgccgaacatgatcgactatttcggacggccgtatgaaggcatcgccgtgttcgacggcaaaaagattactgtcactggaaccctgtggaatgggaacaaaattatcgacgagcgcctgatcaaccccgacggctcactgctgttccgagtaaccatcaatggtgttaccggctggcggctctgcgaacgcattctagcaaatagtcacggctttccgcctgaggttgaagagcaagccgccggtacattgcctatgtcctgcgcacaagaaagcggtatggaccggcacccagccgcttgtgcttcagctcgcatcaacgtc

SEQ ID NO: 327 - DNA, 573 bp, Artificial Sequence
  Description of Artificial Sequence: Synthetic polynucleotide
atgaactccttctccacaagcgccttcggtccagtcgccttctccctgggcctgctcctggtgttgcccgctgcctttcctgccccagtcttcacactcgaagatttcgtaggtgactggcgacagacagccggctacaacctggaccaagttcttgaacagggtggtgtgtccagtttgtttcagaatctcggggtgtccgtaactccaatccagaggatagtcctgagtggtgaaaatgggctgaagatcgacatccatgtcatcatcccttatgaaggtctgagcggcgatcagatggggcagatcgaaaaaatttttaaggtggtgtaccctgtggatgatcatcactttaaggtgatcctgcactatggcacactggtaatcgacggtgttacgccgaacatgatcgactatttcggacggccgtatgaaggcatcgccgtgttcgacggcaaaaagattactgtcactggaaccctgtggaatgggaacaaaattatcgacgagcgcctgatcaaccccgacggctcactgctgttccgagtaaccatcaatggtgttaccggctgg

SEQ ID NO: 328 - protein, 33 aa, Artificial Sequence
  Description of Artificial Sequence: Synthetic polypeptide
GSSGGGSSGGEPTTENLYFQSDNGSSGGGSSGG

SEQ ID NO: 329 - protein, 18 aa, Artificial Sequence
  Description of Artificial Sequence: Synthetic FABP consensus peptide
  MOD_RES (1)..(1): Gly, Ser, Ala, Ile, Val, or Lys
  MOD_RES (2)..(2): Any amino acid except Phe or Glu
  MOD_RES (3)..(3): Phe, Tyr, or Trp
  MOD_RES (4)..(4): Any amino acid
  MOD_RES (5)..(5): Leu, Ile, Val, Met, or Phe
  MOD_RES (6)..(7): Any amino acid
  MOD_RES (8)..(8): Any amino acid except Lys
  MOD_RES (9)..(9): Any amino acid
  MOD_RES (10)..(10): Asn, His, or Gly
  MOD_RES (11)..(11): Phe or Tyr
  MOD_RES (12)..(12): Asp or Glu
  MOD_RES (13)..(13): Any amino acid
  MOD_RES (14)..(14): Leu, Ile, Val, Met, Phe, or Tyr
  MOD_RES (15)..(15): Leu, Ile, Val, or Met
  MOD_RES (16)..(16): Any amino acid except Asn
  MOD_RES (17)..(17): Any amino acid except Gly
  MOD_RES (18)..(18): Leu, Ile, Val, Met, Ala, Lys, or Arg
XXXXXXXXXXXXXXXXXX

SEQ ID NO: 330 - protein, 18 aa, Artificial Sequence
  Description of Artificial Sequence: Synthetic OGLUC consensus peptide
  MOD_RES (1)..(1): Gly, Ser, Ala, Ile, Val, or Lys
  MOD_RES (2)..(2): Any amino acid except Phe or Glu
  MOD_RES (3)..(3): Phe, Tyr, or Trp
  MOD_RES (4)..(4): Any amino acid
  MOD_RES (5)..(5): Leu, Ile, Val, Met, Phe, Ser, Tyr, or Gln
  MOD_RES (6)..(7): Any amino acid
  MOD_RES (8)..(8): Any amino acid except Lys
  MOD_RES (9)..(9): Any amino acid
  MOD_RES (10)..(10): Asn, His, Gly, or Lys
  MOD_RES (11)..(11): Any amino acid
  MOD_RES (12)..(12): Asp or Glu
  MOD_RES (13)..(13): Any amino acid
  MOD_RES (14)..(14): Leu, Ile, Val, Met, Phe, or Tyr
  MOD_RES (15)..(15): Leu, Ile, Val, Met, Trp, or Phe
  MOD_RES (16)..(16): Any amino acid
  MOD_RES (17)..(17): Any amino acid except Gly
  MOD_RES (18)..(18): Leu, Ile, Val, Met, Ala, Lys, Arg, or Gly
XXXXXXXXXXXXXXXXXX

SEQ ID NO: 331 - DNA, 672 bp, Artificial Sequence
  Description of Artificial Sequence: Synthetic polynucleotide
atgggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 332 - protein, 224 aa, Artificial Sequence
  Description of Artificial Sequence: Synthetic polypeptide
MGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 333 - DNA, 468 bp, Artificial Sequence
  Description of Artificial Sequence: Synthetic polynucleotide
atggtgtttacactcgaagatttcgtaggggactggcggcagacagccggctacaacctggaccaagtccttgagcagggcggtctgtccagtttgtttcagaaactcggggtgtccgtaacaccgatccaaaagattgtcctgagcggtgaaaacggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 334 - protein, 156 aa, Artificial Sequence
  Description of Artificial Sequence: Synthetic polypeptide
MVFTLEDFVGDWRQTAGYNLDQVLEQGGLSSLFQKLGVSVTPIQKIVLSGENGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 335 - DNA, 711 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtggcctgaagatcgacatccatgtcatcatcccgtatgaaggtctgagcggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcg

SEQ ID NO: 336 - protein, 237 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGGLKIDIHVIIPYEGLSGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 337 - DNA, 510 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtgtttacactcgaagatttcgtaggggactggcggcagacagccggctacaacctggaccaagtccttgagcagggcggtctgtccagtttgtttcagaaactcggggtgtccgtaacaccgatccaaaagattgtcctgagcggtgaaaac

SEQ ID NO: 338 - protein, 170 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGLSSLFQKLGVSVTPIQKIVLSGEN

SEQ ID NO: 339 - DNA, 513 bp, Artificial Sequence
  Description of Artificial Sequence: Synthetic polynucleotide
atggtgtttacactcgaagatttcgtaggggactggcggcagacagccggctacaacctggaccaagtccttgagcagggcggtgtgtccagtttgtttcagaatctcggggtgtccgtaacaccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcg

SEQ ID NO: 340 - protein, 171 aa, Artificial Sequence; identical to SEQ ID NO: 89
  Description of Artificial Sequence: Synthetic polypeptide

SEQ ID NO: 341 - DNA, 513 bp, Artificial Sequence
  Description of Artificial Sequence: Synthetic polynucleotide
atggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgaacggctatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcg

SEQ ID NO: 342 - protein, 171 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLNGYQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 343 - DNA, 690 bp, Artificial Sequence
  Description of Artificial Sequence: Synthetic polynucleotide
atggtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 344 - protein, 230 aa, Artificial Sequence
  Description of Artificial Sequence: Synthetic polypeptide
MVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 345 - DNA, 492 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggatt

SEQ ID NO: 346 - protein, 164 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRI

SEQ ID NO: 347 - DNA, 687 bp, Artificial Sequence
  Description of Artificial Sequence: Synthetic polynucleotide
atgctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 348 - protein, 229 aa, Artificial Sequence
  Description of Artificial Sequence: Synthetic polypeptide
MLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 349 - DNA, 495 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtc

SEQ ID NO: 350 - protein, 165 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIV

SEQ ID NO: 351 - DNA, 525 bp, Artificial Sequence
  Description of Artificial Sequence: Synthetic polynucleotide
atggacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 352 - protein, 175 aa, Artificial Sequence
  Description of Artificial Sequence: Synthetic polypeptide
MDGVTPNMIDYFGRPYEGIAVFDGKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 353 - DNA, 657 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatc

SEQ ID NO: 354 - protein, 219 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVI

SEQ ID NO: 355 - DNA, 522 bp, Artificial Sequence
  Description of Artificial Sequence: Synthetic polynucleotide
atgggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 356 - protein, 174 aa, Artificial Sequence
  Description of Artificial Sequence: Synthetic polypeptide
MGVTPNMIDYFGRPYEGIAVFDGKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 357 - DNA, 660 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgac

SEQ ID NO: 358 - protein, 220 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVID

SEQ ID NO: 359 - DNA, 519 bp, Artificial Sequence
  Description of Artificial Sequence: Synthetic polynucleotide
atggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 360 - protein, 173 aa, Artificial Sequence
  Description of Artificial Sequence: Synthetic polypeptide
MVTPNMIDYFGRPYEGIAVFDGKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 361 - DNA, 663 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggg

SEQ ID NO: 362 - protein, 221 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDG

SEQ ID NO: 363 - DNA, 396 bp, Artificial Sequence
  Description of Artificial Sequence: Synthetic polynucleotide
atgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 364 - protein, 132 aa, Artificial Sequence
  Description of Artificial Sequence: Synthetic polypeptide
MINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 365 - DNA, 786 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctg

SEQ ID NO: 366 - protein, 262 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERL

SEQ ID NO: 367 - DNA, 390 bp, Artificial Sequence
  Description of Artificial Sequence: Synthetic polynucleotide
atgcccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 368 - protein, 130 aa, Artificial Sequence
  Description of Artificial Sequence: Synthetic polypeptide
MPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 369 - DNA, 792 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaac

SEQ ID NO: 370 - protein, 264 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLIN

SEQ ID NO: 371 - DNA, 384 bp, Artificial Sequence
  Description of Artificial Sequence: Synthetic polynucleotide
atgggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 372 - protein, 128 aa, Artificial Sequence
  Description of Artificial Sequence: Synthetic polypeptide
MGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 373 - DNA, 798 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagcactttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgac

SEQ ID NO: 374 - protein, 266 aa, Artificial Sequence
  Description of Artificial Sequence: Synthetic polypeptide
MGVQVETISPGDGRTFPKRGQTCVVHYTGMLEDGKKFDSSRDRNKHFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPD

SEQ ID NO: 375 - DNA, 381 bp, Artificial Sequence
  Description of Artificial Sequence: Synthetic polynucleotide
atgtccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 376 - protein, 127 aa, Artificial Sequence
  Description of Artificial Sequence: Synthetic polypeptide
MSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 377 - DNA, 801 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggc

SEQ ID NO: 378 - protein, 267 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDG

SEQ ID NO: 379 - DNA, 357 bp, Artificial Sequence
  Description of Artificial Sequence: Synthetic polynucleotide
atgaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 380 - protein, 119 aa, Artificial Sequence
  Description of Artificial Sequence: Synthetic polypeptide
MNGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 381 - DNA, 825 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatc

SEQ ID NO: 382 - protein, 275 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTI

SEQ ID NO: 383 - DNA, 351 bp, Artificial Sequence
  Description of Artificial Sequence: Synthetic polynucleotide
atggtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 384 - protein, 117 aa, Artificial Sequence
  Description of Artificial Sequence: Synthetic polypeptide
MVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 385 - DNA, 831 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgga

SEQ ID NO: 386 - protein, 277 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTING

SEQ ID NO: 387 - DNA, 327 bp, Artificial Sequence
  Description of Artificial Sequence: Synthetic polynucleotide
atgcgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 388 - protein, 109 aa, Artificial Sequence
  Description of Artificial Sequence: Synthetic polypeptide
MRILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 389 - DNA, 855 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaa

SEQ ID NO: 390 - protein, 285 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCE

SEQ ID NO: 391 - DNA, 501 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagc

SEQ ID NO: 392 - protein, 167 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLS

SEQ ID NO: 393 - DNA, 681 bp, Artificial Sequence
  Description of Artificial Sequence: Synthetic polynucleotide
atgggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 394 - protein, 227 aa, Artificial Sequence
  Description of Artificial Sequence: Synthetic polypeptide
MGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 395 - DNA, 507 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaa

SEQ ID NO: 396 - protein, 169 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGE

SEQ ID NO: 397 - DNA, 675 bp, Artificial Sequence
  Description of Artificial Sequence: Synthetic polynucleotide
atgaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 398 - protein, 225 aa, Artificial Sequence
  Description of Artificial Sequence: Synthetic polypeptide
MNGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 399 - DNA, 606 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccct

SEQ ID NO: 400 - protein, 202 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYP

SEQ ID NO: 401 - DNA, 576 bp, Artificial Sequence
  Description of Artificial Sequence: Synthetic polynucleotide
atggtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 402 - protein, 192 aa, Artificial Sequence
  Description of Artificial Sequence: Synthetic polypeptide
MVDDHHFKVILHYGTLVIDGVTPNMIDYFGRPYEGIAVFDGKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 403 - DNA, 612 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggat

SEQ ID NO: 404 - protein, 204 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVD

SEQ ID NO: 405 - DNA, 570 bp, Artificial Sequence
  Description of Artificial Sequence: Synthetic polynucleotide
atggatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 406 - protein, 190 aa, Artificial Sequence
  Description of Artificial Sequence: Synthetic polypeptide
MDHHFKVILHYGTLVIDGVTPNMIDYFGRPYEGIAVFDGKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 407 - DNA, 726 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggc

SEQ ID NO: 408 - protein, 242 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDG

SEQ ID NO: 409 - DNA, 456 bp, Artificial Sequence
  Description of Artificial Sequence: Synthetic polynucleotide
atgaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 410 - protein, 152 aa, Artificial Sequence
  Description of Artificial Sequence: Synthetic polypeptide
MKKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 411 - DNA, 729 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaa

SEQ ID NO: 412 - protein, 243 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGK

SEQ ID NO: 413 - DNA, 453 bp, Artificial Sequence
  Description of Artificial Sequence: Synthetic polynucleotide
atgaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 414 - protein, 151 aa, Artificial Sequence
  Description of Artificial Sequence: Synthetic polypeptide
MKITVTGTLWNGNKIIDERLINPDGSLLFRVTINGVTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 415 - DNA, 864 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctg

SEQ ID NO: 416 - DNA, 864 bp, Artificial Sequence; identical to SEQ ID NO: 415
  Description of Artificial Sequence: Synthetic polynucleotide

SEQ ID NO: 417 - protein, 288 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERIL

SEQ ID NO: 418 - DNA, 318 bp, Artificial Sequence
  Description of Artificial Sequence: Synthetic polynucleotide
atggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 419 - protein, 106 aa, Artificial Sequence
  Description of Artificial Sequence: Synthetic polypeptide
MAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 420 - DNA, 858 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgc

SEQ ID NO: 421 - protein, 286 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCER

SEQ ID NO: 422 - DNA, 324 bp, Artificial Sequence
  Description of Artificial Sequence: Synthetic polynucleotide
atgattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 423 - protein, 108 aa, Artificial Sequence
  Description of Artificial Sequence: Synthetic polypeptide
MILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 424 - DNA, 852 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgc

SEQ ID NO: 425 - protein, 284 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLC

SEQ ID NO: 426 - DNA, 330 bp, Artificial Sequence
  Description of Artificial Sequence: Synthetic polynucleotide
atggaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 427 - protein, 18 aa, Artificial Sequence
  Description of Artificial Sequence: Dinoflagellate luciferase consensus sequence
  MOD_RES (6)..(6): Val or Ile
  MOD_RES (11)..(11): Ala, Val, Thr, or Lys
  MOD_RES (12)..(12): Ala or Glu
  MOD_RES (16)..(16): Glu, Lys, Thr, or Gln
  MOD_RES (17)..(17): Ala or Val
  MOD_RES (18)..(18): Val or Ile
GRWITXSGGQXXFIKXXX

SEQ ID NO: 428 - protein, 110 aa, Artificial Sequence
  Description of Artificial Sequence: Synthetic polypeptide
MERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 429 - DNA, 846 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcgg

SEQ ID NO: 430 - protein, 282 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWR

SEQ ID NO: 431 - DNA, 336 bp, Artificial Sequence
  Description of Artificial Sequence: Synthetic polynucleotide
atgctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 432 - protein, 112 aa, Artificial Sequence
  Description of Artificial Sequence: Synthetic polypeptide
MLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 433 - DNA, 840 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggc

SEQ ID NO: 434 - protein, 280 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTG

SEQ ID NO: 435 - DNA, 342 bp, Artificial Sequence
  Description of Artificial Sequence: Synthetic polynucleotide
atgtggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 436 - protein, 114 aa, Artificial Sequence
  Description of Artificial Sequence: Synthetic polypeptide
MWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 437 - DNA, 834 bp, Artificial Sequence
  Description of Artificial Sequence: Synthetic polynucleotide
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggaggagggagctccggtggaggcagcggtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtg

SEQ ID NO: 438 - protein, 278 aa, Artificial Sequence
  Description of Artificial Sequence: Synthetic polypeptide
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGSSGGGSGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGV

SEQ ID NO: 439 - DNA, 348 bp, Artificial Sequence
  Description of Artificial Sequence: Synthetic polynucleotide
atgaccggctggcggctgtgcgaacgcattctggcgggaggaggtggctcaggtggagggagctccgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctca

SEQ ID NO: 440 - protein, 116 aa, Artificial Sequence
  Description of Artificial Sequence: Synthetic polypeptide
MTGWRLCERILAGGGGSGGGSSVAILWHEMWHEGLEEASRLYFGERNVKGMFEVLEPLHAMMERGPQTLKETSFNQAYGRDLMEAQEWCRKYMKSGNVKDLTQAWDLYYHVFRRIS

SEQ ID NO: 441 - DNA, 447 bp, Artificial Sequence
  Description of Artificial Sequence: Synthetic polynucleotide
atgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgta

SEQ ID NO: 442 - protein, 149 aa, Artificial Sequence
  Description of Artificial Sequence: Synthetic polypeptide
MYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIV

SEQ ID NO: 443 - DNA, 615 bp, Artificial Sequence
  Description of Artificial Sequence: Synthetic polynucleotide
atgacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcag

SEQ ID NO: 444 - protein, 205 aa, Artificial Sequence
  Description of Artificial Sequence: Synthetic polypeptide
MTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQ

SEQ ID NO: 445 - DNA, 615 bp, Artificial Sequence
  Description of Artificial Sequence: Synthetic polynucleotide
atgcatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatc

SEQ ID NO: 446 - protein, 205 aa, Artificial Sequence
  Description of Artificial Sequence: Synthetic polypeptide
MHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDI

SEQ ID NO: 447 - DNA, 615 bp, Artificial Sequence
  Description of Artificial Sequence: Synthetic polynucleotide
atggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcgggaagttctggtggaggaagttctggtggagagcctactactgagaacttgtacttccagagcgataacggaagttctggtggaggaagttctggtggaatggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactg

SEQ ID NO: 448 - protein, 205 aa, Artificial Sequence
  Description of Artificial Sequence: Synthetic polypeptide
MVIDGVTPNMIDYFGRPYEGIAVFDGKKITVTGTLWNGNKIIDERLINPDGSLLFRVTINGVTGWRLCERILAGSSGGGSSGGEPTTENLYFQSDNGSSGGGSSGGMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTL

SEQ ID NO: 449 - DNA, 2019 bp, Homo sapiens
atggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaagtttgctgttttgtggtccacaagaggtgccatgaatttgttactttttcttgtccgggtgcggataagggacccgacactgatgaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtacaagttgcttaaccaagaagaaggtgagtactacaacgtacccattccggaaggggacgaggaaggaaacatggaactcaggcagaaattcgagaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggatcggctgtacttcgtcatggaatatgtcaacggtggggacctcatgtaccacattcagcaagtaggaaaatttaaggaaccacaagcagtattctatgcggcagagatttccatcggattgttctttcttcataaaagaggaatcatttatagggatctgaagttagataacgtcatgttggattcagaaggacatatcaaaattgctgactttgggatgtgcaaggaacacatgatggatggagtcacgaccaggaccttctgtgggactccagattatatcgccccagagataatcgcttatcagccgtatggaaaatctgtggactggtgggcctatggcgtcctgttgtatgaaatgcttgccgggcagcctccatttgatggtgaagatgaagacgagctatttcagtctatcatggagcacaacgtttcctatccaaaatccttgtccaaggaggctgtttctatctgcaaaggactgatgaccaaacacccagccaagcggctgggctgtgggcctgagggggagagggacgtgagagagcatgccttcttccggaggatcgactgggaaaaactggagaacagggagatccagccaccattcaagcccaaagtgtgtggcaaaggagcagagaactttgacaagttcttcacacgaggacagcccgtcttaacaccacctgatcagctggttattgctaacatagaccagtctgattttgaagggttctcgtatgtcaacccccagtttgtgcaccccatcttacagagtgcagtagtt

SEQ ID NO: 450 - protein, 673 aa, Homo sapiens
MADVFPGNDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNMELRQKFEKAKLGPAGNKVISPSEDRKQPSNNLDRVKLTDFNFLMVLGKGSFGKVMLADRKGTEELYAIKILKKDVVIQDDDVECTMVEKRVLALLDKPPFLTQLHSCFQTVDRLYFVMEYVNGGDLMYHIQQVGKFKEPQAVFYAAEISIGLFFLHKRGIIYRDLKLDNVMLDSEGHIKIADFGMCKEHMMDGVTTRTFCGTPDYIAPEIIAYQPYGKSVDWWAYGVLLYEMLAGQPPFDGEDEDELFQSIMEHNVSYPKSLSKEAVSICKGLMTKHPAKRLGCGPEGERDVREHAFFRRIDWEKLENREIQPPFKPKVCGKGAENFDKFFTRGQPVLTPPDQLVIANIDQSDFEGFSYVNPQFVHPILQSAVV

SEQ ID NO: 451 - DNA, 2334 bp, Homo sapiens
atggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaaggtt

SEQ ID NO: 452 - protein, 778 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQKV

SEQ ID NO: 453 - DNA, 54 bp, Artificial Sequence
  Description of Artificial Sequence: Synthetic oligonucleotide
ggtggttcaggtggtggcgggagcggtggagggagcagcggtggagcgatcgcc

SEQ ID NO: 454 - protein, 18 aa, Artificial Sequence
  Description of Artificial Sequence: Synthetic peptide
GGSGGGGSGGGSSGGAIA

SEQ ID NO: 455 - DNA, 51 bp, Artificial Sequence
  Description of Artificial Sequence: Synthetic oligonucleotide
tctctcggtggttcaggtggtggcgggagcggtggagggagcagcggtgga

SEQ ID NO: 456 - protein, 17 aa, Artificial Sequence
  Description of Artificial Sequence: Synthetic peptide
SLGGSGGGGSGGGSSGG

SEQ ID NO: 457 - DNA, 11 bp, Artificial Sequence
  Description of Artificial Sequence: Synthetic oligonucleotide
gctcgagcgga

SEQ ID NO: 458 - protein, 4 aa, Artificial Sequence
  Description of Artificial Sequence: Synthetic peptide
GSSG

SEQ ID NO: 459 - DNA, 1080 bp, Homo sapiens
atgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtga

SEQ ID NO: 460 - protein, 359 aa, Homo sapiens [sequence omitted]

SEQ ID NO: 461 - DNA, 87 bp, Homo sapiens
atgaactccttctccacaagcgccttcggtccagttgccttctccctggggctgctcctggtgttgcctgctgccttccctgcccca

SEQ ID NO: 462 - protein, 29 aa, Homo sapiens
MNSFSTSAFGPVAFSLGLLLVLPAAFPAP

SEQ ID NO: 463 - DNA, 597 bp, Artificial Sequence
  Description of Artificial Sequence: Synthetic polynucleotide
atgaactccttctccacaagcgccttcggtccagttgccttctccctggggctgctcctggtgttgcctgctgccttccctgccccagtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcg

SEQ ID NO: 464 - protein, 199 aa, Artificial Sequence
  Description of Artificial Sequence: Synthetic polypeptide
MNSFSTSAFGPVAFSLGLLLVLPAAFPAPVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 465 - DNA, 591 bp, Artificial Sequence
  Description of Artificial Sequence: Synthetic polynucleotide
atggcttactccacactgttcatcattgctctcacagccgtcgtaacacaagcctcctccacacagaaaagcaacctgacagtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagcgcattttggcg

SEQ ID NO: 466 - protein, 197 aa, Artificial Sequence
  Description of Artificial Sequence: Synthetic polypeptide
MAYSTLFIIALTAVVTQASSTQKSNLTVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 467 - DNA, 1023 bp, Artificial Sequence
  Description of Artificial Sequence: Synthetic polynucleotide
atgttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagat

SEQ ID NO: 468 - protein, 341 aa, Artificial Sequence
  Description of Artificial Sequence: Synthetic polypeptide
MFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLED

SEQ ID NO: 469 - DNA, 1023 bp, Artificial Sequence
  Description of Artificial Sequence: Synthetic polynucleotide
atgcagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcga

SEQ ID NO: 470 - protein, 341 aa, Artificial Sequence
  Description of Artificial Sequence: Synthetic polypeptide
MQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWR

SEQ ID NO: 471 - DNA, 1023 bp, Artificial Sequence
  Description of Artificial Sequence: Synthetic polynucleotide
atgggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagc

SEQ ID NO: 472 - protein, 341 aa, Artificial Sequence
  Description of Artificial Sequence: Synthetic polypeptide
MGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLS

SEQ ID NO: 473 - DNA, 1023 bp, Artificial Sequence
  Description of Artificial Sequence: Synthetic polynucleotide
atgctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatggg

SEQ ID NO: 474 - protein, 341 aa, Artificial Sequence
  Description of Artificial Sequence: Synthetic polypeptide
MLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENG

SEQ ID NO: 475 - DNA, 1023 bp, Artificial Sequence
  Description of Artificial Sequence: Synthetic polynucleotide
atggacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatc

SEQ ID NO: 476 - protein, 341 aa, Artificial Sequence
  Description of Artificial Sequence: Synthetic polypeptide
MDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKI

SEQ ID NO: 477 - DNA, 1023 bp, Artificial Sequence
  Description of Artificial Sequence: Synthetic polynucleotide
atggtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccct

SEQ ID NO: 478 - protein, 341 aa, Artificial Sequence
  Description of Artificial Sequence: Synthetic polypeptide
MVDDHHFKVILHYGTLVIDGVTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYP

SEQ ID NO: 479 - DNA, 1023 bp, Artificial Sequence
  Description of Artificial Sequence: Synthetic polynucleotide
atggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtg

SEQ ID NO: 480 - protein, 341 aa, Artificial Sequence
  Description of Artificial Sequence: Synthetic polypeptide
MDDHHFKVILHYGTLVIDGVTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPV

SEQ ID NO: 481 - DNA, 1023 bp, Artificial Sequence
  Description of Artificial Sequence: Synthetic polynucleotide
atgacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggtt

SEQ ID NO: 482 - protein, 341 aa, Artificial Sequence
  Description of Artificial Sequence: Synthetic polypeptide
MTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGV

SEQ ID NO: 483 - DNA, 1023 bp, Artificial Sequence
  Description of Artificial Sequence: Synthetic polynucleotide
atgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtg

SEQ ID NO: 484 - protein, 341 aa, Artificial Sequence
  Description of Artificial Sequence: Synthetic polypeptide
MFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAV

SEQ ID NO: 485 - DNA, 1023 bp, Artificial Sequence
  Description of Artificial Sequence: Synthetic polynucleotide
atgaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggc

SEQ ID NO: 486 - protein, 341 aa, Artificial Sequence
  Description of Artificial Sequence: Synthetic polypeptide
MKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDG

SEQ ID NO: 487 - DNA, 1023 bp, Artificial Sequence
  Description of Artificial Sequence: Synthetic polynucleotide
atgaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaa

SEQ ID NO: 488 - protein, 341 aa, Artificial Sequence
  Description of Artificial Sequence: Synthetic polypeptide
MKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGK

SEQ ID NO: 489 - DNA, 1023 bp, Artificial Sequence
  Description of Artificial Sequence: Synthetic polynucleotide
atgatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaag

SEQ ID NO: 490 - protein, 341 aa, Artificial Sequence
  Description of Artificial Sequence: Synthetic polypeptide
MITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKK

SEQ ID NO: 491 - DNA, 1023 bp, Artificial Sequence
  Description of Artificial Sequence: Synthetic polynucleotide
atgaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacaggg

SEQ ID NO: 492 - protein, 341 aa, Artificial Sequence
  Description of Artificial Sequence: Synthetic polypeptide
MTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTG

SEQ ID NO: 493 - DNA, 1023 bp, Artificial Sequence
  Description of Artificial Sequence: Synthetic polynucleotide
atgcccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaac

SEQ ID NO: 494 - protein, 341 aa, Artificial Sequence
  Description of Artificial Sequence: Synthetic polypeptide
MPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLIN

SEQ ID NO: 495 - DNA, 1023 bp, Artificial Sequence
  Description of Artificial Sequence: Synthetic polynucleotide
atgtccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggc

SEQ ID NO: 496 - protein, 341 aa, Artificial Sequence
  Description of Artificial Sequence: Synthetic polypeptide
MSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDG

SEQ ID NO: 497 - DNA, 1023 bp, Artificial Sequence
  Description of Artificial Sequence: Synthetic polynucleotide
atgggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaac

SEQ ID NO: 498 - protein, 341 aa, Artificial Sequence
  Description of Artificial Sequence: Synthetic polypeptide
MGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTIN

SEQ ID NO: 499 - DNA, 1020 bp, Artificial Sequence
  Description of Artificial Sequence: Synthetic polynucleotide
atggtcttcacactcgaagatagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 500 - protein, 340 aa, Artificial Sequence
  Description of Artificial Sequence: Synthetic polypeptide
MVFTLEDSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 501 - DNA, 1020 bp, Artificial Sequence
  Description of Artificial Sequence: Synthetic polynucleotide
atggtcttcacactcgaagatttcgttggggactggcgaagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctcagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 502 - protein, 340 aa, Artificial Sequence
  Description of Artificial Sequence: Synthetic polypeptide
MVFTLEDFVGDWRSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 503 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 504 - protein, 340 aa, Artificial Sequence
  Description of Artificial Sequence: Synthetic polypeptide
MVFTLEDFVGDWRQTAGYNLDQVLEQGSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 505 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 506 - protein, 340 aa, Artificial Sequence
  Description of Artificial Sequence: Synthetic polypeptide
MVFTLEDFVGDWRQTAGYNLDQVLEQGGVSSLFQNLGVSVTPIQRISASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 507 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 508 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 509 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 510 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 511 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 512 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKISASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 513 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 514 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 515 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtgagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctgatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 516 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 517 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 518 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSDHHFKVILHYGTLVIDGVTPNMIDYFGRPYEGIAVFDGKKITVTGTLWNGNKIIDERLINPDGSLLFRVTINGVTGWRLCERILA

SEQ ID NO: 519 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 520 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVISASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSDGVTPNMIDYFGRPYEGIAVFDGKKITVTGTLWNGNKIIDERLINPDGSLLFRVTINGVTGWRLCERILA

SEQ ID NO: 521 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 522 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSGVTPNMIDYFGRPYEGIAVFDGKKITVTGTLWNGNKIIDERLINPDGSLLFRVTINGVTGWRLCERILA

SEQ ID NO: 523 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacgggagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctgttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 524 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSVTPNMIDYFGRPYEGIAVFDGKKITVTGTLWNGNKIIDERLINPDGSLLFRVTINGVTGWRLCERILA

SEQ ID NO: 525 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 526 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSTPNMIDYFGRPYEGIAVFDGKKITVTGTLWNGNKIIDERLINPDGSLLFRVTINGVTGWRLCERILA

SEQ ID NO: 527 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 528 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSFDGKKITVTGTLWNGNKIIDERLINPDGSLLFRVTINGVTGWRLCERILA

SEQ ID NO: 529 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 530 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSKKITVTGTLWNGNKIIDERLINPDGSLLFRVTINGVTGWRLCERILA

SEQ ID NO: 531 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctaagatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 532 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSKITVTGTLWNGNKIIDERLINPDGSLLFRVTINGVTGWRLCERILA

SEQ ID NO: 533 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatcactgtaacagggaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 534 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSITVTGTLWNGNKIIDERLINPDGSLLFRVTINGVTGWRLCERILA

SEQ ID NO: 535 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctaccctgtggaacggcaacaaaattatcgacgagcgcctgatcaaccccgacggctccctgctgttccgagtaaccatcaacggagtgaccggctggcggctgtgcgaacgcattctggct

SEQ ID NO: 536 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSTLWNGNKIIDERLINPDGSLLFRVTINGVTGWRLCERILA

SEQ ID NO: 537 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctaaaattatcgacgagcgcctgatcaaccccgacggctccctgctgttccgagtaaccatcaacggagtgaccggctggcggctgtgcgaacgcattctggct

SEQ ID NO: 538 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSKIIDERLINPDGSLLFRVTINGVTGWRLCERILA

SEQ ID NO: 539 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatcaaccccgacggctccctgctgttccgagtaaccatcaacggagtgaccggctggcggctgtgcgaacgcattctggct

SEQ ID NO: 540 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSINPDGSLLFRVTINGVTGWRLCERILA

SEQ ID NO: 541 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaacagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctcccgacggctccctgctgttccgagtaaccatcaacggagtgaccggctggcggctgtgcgaacgcattctggct

SEQ ID NO: 542 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSPDGSLLFRVTINGVTGWRLCERILA

SEQ ID NO: 543 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctggctccctgctgttccgagtaaccatcaacggagtgaccggctggcggctgtgcgaacgcattctggct

SEQ ID NO: 544 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSGSLLFRVTINGVTGWRLCERILA

SEQ ID NO: 545 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggcagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttcttccctgctgttccgagtaaccatcaacggagtgaccggctggcggctgtgcgaacgcattctggct

SEQ ID NO: 546 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSSLLFRVTINGVTGWRLCERILA

SEQ ID NO: 547 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctaacggagtgaccggctggcggctgtgcgaacgcattctggct

SEQ ID NO: 548 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTISASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSNGVTGWRLCERILA

SEQ ID NO: 549 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctggagtgaccggctggcggctgtgcgaacgcattctggct

SEQ ID NO: 550 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSGVTGWRLCERILA

SEQ ID NO: 551 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggaagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctgtgaccggctggcggctgtgcgaacgcattctggct

SEQ ID NO: 552 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGSASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSVTGWRLCERILA

SEQ ID NO: 553 - DNA, 1020 bp, Artificial Sequence
  Description of Artificial Sequence: Synthetic polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaaagcgctagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctcgcattctggct

SEQ ID NO: 554 - protein, 340 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCESASGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSRILA

SEQ ID NO: 555 - DNA, 1023 bp, Artificial Sequence
  Description of Artificial Sequence: Synthetic polynucleotide
atgggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacaggga

SEQ ID NO: 556 - protein, 341 aa, Artificial Sequence
  Description of Artificial Sequence: Synthetic polypeptide
MGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQG

SEQ ID NO: 557 - DNA, 1023 bp, Artificial Sequence
  Description of Artificial Sequence: Synthetic polynucleotide
atggtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggatt

SEQ ID NO: 558 - protein, 341 aa, Artificial Sequence
  Description of Artificial Sequence: Synthetic polypeptide
MVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRI

SEQ ID NO: 559 - DNA, 1026 bp, Artificial Sequence
  Description of Artificial Sequence: Synthetic polynucleotide
atggacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgac

SEQ ID NO: 560 - protein, 342 aa, Artificial Sequence
  Description of Artificial Sequence: Synthetic polypeptide
MDGVTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVID

SEQ ID NO: 561 - DNA, 1026 bp, Artificial Sequence
  Description of Artificial Sequence: Synthetic polynucleotide
atgggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggg

SEQ ID NO: 562 - protein, 342 aa, Artificial Sequence
  Description of Artificial Sequence: Synthetic polypeptide
MGVTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDG

SEQ ID NO: 563 - DNA, 1026 bp, Artificial Sequence
  Description of Artificial Sequence: Synthetic polynucleotide
atggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggtt

SEQ ID NO: 564 - protein, 342 aa, Artificial Sequence
  Description of Artificial Sequence: Synthetic polypeptide
MVTPNMIDYFGRPYEGIAVFDGKKITVTGTLWNGNKIIDERLINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGV

SEQ ID NO: 565 - DNA, 1026 bp, Artificial Sequence
  Description of Artificial Sequence: Synthetic polynucleotide
atgatcaaccccgacggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatc

SEQ ID NO: 566 - protein, 342 aa, Artificial Sequence
  Description of Artificial Sequence: Synthetic polypeptide
MINPDGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLI

SEQ ID NO: 567 - DNA, 1026 bp, Artificial Sequence
  Description of Artificial Sequence: Synthetic polynucleotide
atgggctccctgctgttccgagtaaccatcaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggc

SEQ ID NO: 568 - protein, 342 aa, Artificial Sequence
  Description of Artificial Sequence: Synthetic polypeptide
MGSLLFRVTINGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDG

SEQ ID NO: 569 - DNA, 1026 bp, Artificial Sequence
  Description of Artificial Sequence: Synthetic polynucleotide
atgaacggagtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaac

SEQ ID NO: 570 - protein, 342 aa, Artificial Sequence
  Description of Artificial Sequence: Synthetic polypeptide
MNGVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTIN

SEQ ID NO: 571 - DNA, 1026 bp, Artificial Sequence
  Description of Artificial Sequence: Synthetic polynucleotide
atggtgaccggctggcggctgtgcgaacgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtg

SEQ ID NO: 572 - protein, 342 aa, Artificial Sequence
  Description of Artificial Sequence: Synthetic polypeptide
MVTGWRLCERILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGV

SEQ ID NO: 573 - DNA, 1026 bp, Artificial Sequence
  Description of Artificial Sequence: Synthetic polynucleotide
atgcgcattctggctagctcaagcggaggttcaggcggttccggaatgtatgaaagctttattgagtcactgccattccttaaatctttggagttttctgcacgcctgaaagtagtagatgtgataggcaccaaagtatacaacgatggagaacaaatcattgctcagggagattcggctgattcttttttcattattgaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtatggaacgaacatggatattgtagggtcaggtggatctggaggtagctcttctatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgc

SEQ ID NO: 574 - protein, 342 aa, Artificial Sequence
  Description of Artificial Sequence: Synthetic polypeptide
MRILASSSGGSGGSGMYESFIESLPFLKSLEFSARLKVVDVIGTKVYNDGEQIIAQGDSADSFFIIESGEVKITMKRKGKSEVEENGAVEIARCSRGQYFGELALVTNKPRAASAHAIGTVKCLAMDVQAFERLLGPCMEIMKRNIATYEEQLVALYGTNMDIVGSGGSGGSSSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCER

SEQ ID NO: 575 - DNA, 30 bp, Artificial Sequence
  Description of Artificial Sequence: Synthetic oligonucleotide
gggtcaggtggatctggaggtagctcttct

SEQ ID NO: 576 - DNA, 30 bp, Artificial Sequence
  Description of Artificial Sequence: Synthetic oligonucleotide
agctcaagcggaggttcaggcggttccgga

SEQ ID NO: 577 - DNA, 377 bp, Homo sapiens
atgccgtccgagaagaccttcaaacagcgccggagcttcgaacaaagagtggaagatgtccggctcatccgggagcagcaccccaccaagatcccagtgattatagagcgatacaagggtgagaagcagctgcccgtcctggacaagaccagttccttgtacctgatcacgtgaatatgagcgaactcatcaagataattagaaggcgcctgcagctcaatgctaaccaagccttcttcctcctggtgaatgggcacagcatggtgagtgtgtccacacccatctctgaagtgtacgagagcgagagagatgaagacggcttcctgtacatggtctatgcctcccaggagacgttcgggacagcactggctgtgtaa

SEQ ID NO: 578 - protein, 125 aa, Homo sapiens
MPSEKTFKQRRSFEQRVEDVRLIREQHPTKIPVIIERYKGEKQLPVLDKTKFLVPDHVNMSELIKIIRRRLQLNANQAFFLLVNGHSMVSVSTPISEVYESERDEDGFLYMVYASQETFGTALAV

SEQ ID NO: 579 - protein, 6 aa, Artificial Sequence
  Description of Artificial Sequence: Synthetic peptide
GSAIVK

SEQ ID NO: 580 - protein, 4 aa, Artificial Sequence
  Description of Artificial Sequence: Synthetic peptide
NHGK

SEQ ID NO: 581 - protein, 4 aa, Unknown
  Description of Unknown: Caspase-3 cleavage sequence
SILM

SEQ ID NO: 582-591 - skipped (10 entries)

SEQ ID NO: 592 - DNA, 936 bp, Artificial Sequence
  Description of Artificial Sequence: Synthetic polynucleotide
atggtgtttacactcgaagatttcgtaggggactggcggcagacagccggctacaacctggaccaagtccttgagcagggcggtgtgtccagtttgtttcagaatctcggggtgtccgtaactccgatccaaaggattgtcctgagcggtgaaaacggcctgaagatcgacatccatgtcatcatcccgtatgaaggtctgagcggcgatcagatgggccagatcgaaaaaatttttaaggtggtgtaccctgtggatgatcatcactttaaggtgattctgcactatggcacactggtaatcgacggggttacgccgaacatgatcgactatttcggacggccgtatgaaggcatcgccgtgttcgacggcaaaaagatcactgtaaccgggaccctgtggaacggcaacaaaattatcgacgagcgcctgatcaaccccgacggctccctgctgttccgcgtaaccatcaacggagtgaccggctggcggctgtgcgagagaattttggcgggctcgagcggaggtggaggttcaggtggtggcgggagcggtggaatgccgtccgagaagaccttcaaacagcgccggagcttcgaacaaagagtggaagatgtccggctcatccgggagcagcaccccaccaagatcccagtgattatagagcgatacaagggtgagaagcagctgcccgtcctggacaagaccaagttccttgtacctgatcacgtgaatatgagcgaactcatcaagataattagaaggcgcctgcagctcaatgctaaccaagccttcttcctcctggtgaatgggcacagcatggtgagtgtgtccacacccatctctgaagtgtacgagagcgagagagatgaagacggcttcctgtacatggtctatgcctcccaggagacgttcgggacagcactggctgtgtaa

SEQ ID NO: 593 - protein, 311 aa, Artificial Sequence
  Description of Artificial Sequence: Synthetic polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGSSGGGGSGGGGSGGMPSEKTFKQRRSFEQRVEDVRLIREQHPTKIPVIIERYKGEKQLPVLDKTKFLVPDHVNMSELIKIIRRRLQLNANQAFFLLVNGHSMVSVSTPISEVYESERDEDGFLYMVYASQETFGTALAV

What is claimed is:

1. An isolated polynucleotide encoding a polypeptide comprising an amino acid sequence having at least 95% sequence identity with the amino acid sequence of SEQ ID NO: 1 with the exception of one or more amino acid substitutions at a position corresponding to positions 18, 27, 43, 38, 109, 15, 19, 21, 22, 36, 40, 56, 58, 70, 93, 95, 102, 110, 112, 119, 127, 128, 149, 152, 155, 158, 159, 1, 6, 10, 14, 16, 24, 25, 31, 32, 39, 42, 46, 47, 48, 49, 50, 55, 59, 60, 66, 67, 69, 71, 74, 86, 87, 94, 96, 97, 98, 100, 106, 111, 113, 117, 125, 126, 129, 130, 136, 142, 145, 146, 147, 148, 150, 154, 163, or 168 of the amino acid sequence SEQ ID NO: 1, and optionally one or more amino acid substitutions at a position corresponding to positions 4, 33, 54, 68, 72, 75, 90, and 166 of the amino acid sequence of SEQ ID NO: 1; and wherein said polypeptide has enhanced luminescence activity relative to the amino acid sequence of SEQ ID NO: 3.

2. The polynucleotide of claim 1, wherein said at least one amino acid substitution corresponds to aspartate, phenylalanine, glycine, histidine, isoleucine, lysine, leucine, methionine, asparagine, proline, arginine, serine, valine, tryptophan, or tyrosine at position 18, leucine, valine, alanine, aspartate, glycine or isoleucine at position 27, asparagine at position 43, isoleucine or phenylalanine at position 38, phenylalanine at position 109, arginine at position 15, asparagine at position 19, leucine or methionine at position 21, isoleucine or phenylalanine at position 22, methionine or glutamate at position 36, threonine, isoleucine, leucine or glutamine at position 40, valine at position 56, isoleucine or leucine at position 58, valine at position 70, arginine at position 93, serine or aspartate at position 95, methionine, glutamate, or threonine at position 102, isoleucine at position 110, cysteine at position 112, methionine at position 119, alanine at position 127, alanine or serine at position 128, isoleucine or methionine at position 149, histidine, serine, glutamate or threonine at position 152, threonine at position 155, isoleucine at position 158, serine or isoleucine at position 159, isoleucine at position 1, tyrosine at position 6, tyrosine at position 10, valine or serine at position 14, glutamate at position 16, alanine at position 24, leucine at position 25, isoleucine at position 31, proline or histidine at position 32, isoleucine at position 39, histidine at position 42, glutamine at position 46, proline at position 47, arginine at position 48, aspartate, glycine, or lysine at position 49, lysine or serine at position 50, glycine or glutamate at position 55, threonine at position 59, valine at position 60, threonine or asparagine at position 66, serine or aspartate at position 67, histidine at position 69, aspartate at position 71, lysine or isoleucine at position 74, arginine or leucine at position 86, asparagine or threonine at position 87, phenylalanine at position 94, alanine at position 96, glutamate at position 97, phenylalanine at position 98, isoleucine at position 100, isoleucine or lysine at position 106, asparagine at position 111, histidine, threonine, or lysine at position 113, phenylalanine at position 117, leucine at position 125, arginine at position 126, glutamine at position 129, lysine at position 130, methionine at position 136, valine, glutamate, lysine or tryptophan at position 142, leucine or glutamine at position 145, glycine at position 146, asparagine at position 147, threonine at position 148, valine at position 150, serine at position 154, isoleucine at position 163, or phenylalanine at position 168 of the amino acid sequence of SEQ ID NO: 1.

3. The polynucleotide of claim 1, wherein said amino acid substitutions are at positions corresponding to positions 54 and 90 of the amino acid sequence of SEQ ID NO: 1 and at least one or more amino acid substitution at a position corresponding to positions 1, 10, 14, 16, 18, 24, 25, 27, 38, 40, 43, 70, 87, 97, 100, 102, 111, 113, 125, 129, 130, 142, 146, 147, 149, 150, or 152 of the amino acid sequence of SEQ ID NO: 1.

4. The polynucleotide of claim 3, wherein said amino acid substitution corresponds to isoleucine or alanine at position 54 and valine at position 90 of the amino acid sequence of SEQ ID NO: 1.

5. The polynucleotide of claim 3, wherein said polypeptide comprises the amino acid sequence of SEQ ID NO: 15.

6. The polynucleotide of claim 3, wherein said at least one or more amino acid substitutions are at a position corresponding to positions 18, 68, 72, and 75 of the amino acid sequence of SEQ ID NO: 1.

7. The polynucleotide of claim 6, wherein said amino acid substitution corresponds to leucine at position 18, tyrosine at position 68, glutamine at position 72 and lysine at position 75 of the amino acid sequence of SEQ ID NO: 1.

8. The polynucleotide of claim 3, wherein said at least one or more amino acid substitution are at a position corresponding to positions 18, 33, 27, 43, 68, 72, and 75 of the amino acid sequence of SEQ ID NO: 1.

9. The polynucleotide of claim 8, wherein said amino acid substitution corresponds to asparagine at position 33, valine at position 27, arginine at position 43 and aspartate at position 68 of the amino acid sequence of SEQ ID NO: 1.

10. The polynucleotide of claim 1, wherein said polynucleotide is codon-optimized.

11. The polynucleotide of claim 1, wherein said polynucleotide further encodes a polypeptide of interest linked to said polypeptide having enhanced luminescence activity wherein said polypeptide of interest and said polypeptide having enhanced luminescence activity are capable of being expressed as a fusion protein.

12. The polynucleotide of claim 1, wherein said polypeptide is a soluble monomer.

13. A vector comprising the polynucleotide of claim 1.

14. The vector of claim 13, wherein said polynucleotide is operably linked to a promoter.

15. A cell comprising the polynucleotide of claim 1.
16. A non-human transgenic animal comprising said cell of claim 15.

* * * * *